US011980207B2

(12) United States Patent
Geistlinger et al.

(10) Patent No.: US 11,980,207 B2
(45) Date of Patent: *May 14, 2024

(54) RECOMBINANT COMPONENTS AND COMPOSITIONS FOR USE IN FOOD PRODUCTS

(71) Applicant: PERFECT DAY, INC., Berkeley, CA (US)

(72) Inventors: Timothy Geistlinger, Oakland, CA (US); Heather Jensen, Oakland, CA (US); Ravirajsinh Jhala, Castro Valley, CA (US); Hendrik Meerman, Encinitas, CA (US); Balakrishnan Ramesh, Berkeley, CA (US); Ty Wagoner, Emeryville, CA (US); Timothy Scott Johnson, Oakland, CA (US); Vincent Wei-Xiang Wu, Berkeley, CA (US); Francesca Manea, Oakland, CA (US)

(73) Assignee: Perfect Day, Inc., Berkeley, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/239,325

(22) Filed: Apr. 23, 2021

(65) Prior Publication Data

US 2021/0329941 A1    Oct. 28, 2021

Related U.S. Application Data

(63) Continuation of application No. 17/285,589, filed as application No. PCT/US2019/056703 on Oct. 17, 2019.

(60) Provisional application No. 62/746,918, filed on Oct. 17, 2018.

(51) Int. Cl.
| | |
|---|---|
| *A23J 1/00* | (2006.01) |
| *A23G 9/38* | (2006.01) |
| *A23J 1/18* | (2006.01) |
| *A23J 1/20* | (2006.01) |
| *A23L 29/00* | (2016.01) |
| *C12N 9/16* | (2006.01) |
| *C12N 9/18* | (2006.01) |
| *C12N 9/20* | (2006.01) |

(52) U.S. Cl.
CPC .......... *A23J 1/202* (2013.01); *A23G 9/38* (2013.01); *A23J 1/006* (2013.01); *A23J 1/008* (2013.01); *A23J 1/009* (2013.01); *A23J 1/205* (2013.01); *A23L 29/06* (2016.08); *C12N 9/16* (2013.01); *C12N 9/18* (2013.01); *C12N 9/20* (2013.01); *C12Y 301/01074* (2013.01); *A23V 2002/00* (2013.01); *C12Y 301/01001* (2013.01); *C12Y 301/01003* (2013.01); *C12Y 301/01004* (2013.01); *C12Y 301/01005* (2013.01); *C12Y 301/01006* (2013.01); *C12Y 301/04003* (2013.01)

(58) Field of Classification Search
None
See application file for complete search history.

(56) References Cited

U.S. PATENT DOCUMENTS

| | | |
|---|---|---|
| 3,873,751 A | 3/1975 | Arndt |
| 4,378,376 A | 3/1983 | Wagner |
| 5,514,655 A | 5/1996 | Dewille |
| 6,777,016 B2 | 8/2004 | Thresher |
| 6,903,193 B1 * | 6/2005 | Royer .................. C12N 9/2482 435/254.11 |
| 7,303,877 B2 | 12/2007 | Connelly |
| 8,124,162 B2 | 2/2012 | Passe |
| 9,066,537 B2 | 6/2015 | Hofman |
| 9,682,119 B2 | 6/2017 | Hofman |
| 9,932,591 B2 | 4/2018 | Lee |
| 2002/0160445 A1 | 10/2002 | Harboe |
| 2005/0170062 A1 | 8/2005 | Burling |
| 2005/0204454 A1 | 9/2005 | Wu |
| 2009/0233293 A1 | 9/2009 | Albang |
| 2009/0324574 A1 | 12/2009 | Mathur |
| 2009/0324575 A1 | 12/2009 | Mathur |
| 2010/0047877 A1 | 2/2010 | Albermann |
| 2010/0119691 A1 | 5/2010 | Huang |
| 2010/0209985 A1 | 8/2010 | Buchert |
| 2010/0292168 A1 | 11/2010 | Hernandez |
| 2013/0189330 A1 | 7/2013 | Tani |
| 2014/0065264 A1 | 3/2014 | Do |
| 2015/0225705 A1 | 8/2015 | McBride et al. |
| 2015/0237885 A1 | 8/2015 | Boursier |
| 2015/0313251 A1 * | 11/2015 | Pascual ................. A23L 29/256 426/584 |
| 2016/0244777 A1 | 8/2016 | Coffin |

(Continued)

FOREIGN PATENT DOCUMENTS

| | | |
|---|---|---|
| WO | 2008052062 | 5/2008 |
| WO | 2013148688 | 10/2013 |

(Continued)

OTHER PUBLICATIONS

Guo et al., Comp. Struct. Biotechnol. J. 15:161-167, 2017 (Year: 2017).*
Zhou et al., Cell Mol Life Sci 63:2260-2290, 2006 (Year: 2006).*
Kozak, M., Gene 234:187-208, 1999 (Year: 1999).*
Routledge et al., Microbial Cell Factories 10:17, 2011, 11 pages (Year: 2011).*
Horii et al., Enzyme and Microbial Technology 46:194-199, 2010 (Year: 2010).*
Son et al., "Lipase and Protease Double-Deletion Mutant of Pseudomonas fluorescens Suitable for Extracellular Protein Production", Appl. Environ. Microbiol. 78:8454-8462, 2012 (Year: 2012).*

(Continued)

*Primary Examiner* — David Steadman
(74) *Attorney, Agent, or Firm* — David R. Conklin; Kirton McConkie

(57) ABSTRACT

Provided are methods for producing food products comprising recombinant components, and compositions used in and food products produced by such methods.

31 Claims, 10 Drawing Sheets

Specification includes a Sequence Listing.

(56) References Cited

U.S. PATENT DOCUMENTS

| | | | |
|---|---|---|---|
| 2017/0037320 A1 | 2/2017 | Vanhercke | |
| 2017/0273328 A1* | 9/2017 | Pandya | .................. A23C 11/04 |

FOREIGN PATENT DOCUMENTS

| | | |
|---|---|---|
| WO | 2016029193 | 2/2016 |
| WO | 2016049198 | 3/2016 |
| WO | 2018039499 | 3/2018 |
| WO | 2018039632 | 3/2018 |
| WO | 2020176734 | 9/2020 |

OTHER PUBLICATIONS

Roussel et al., "A Cutinase from Trichoderma reesei with a Lid-Covered Active Site and Kinetic Properties of True Lipases", J. Mol. Biol. 42:3757-3772, 2014 (Year: 2014).*

GenBank Accession No. ETS01199, Mar. 2015, 2 pages (Year: 2015).*

Stahl et al., The Plant Cell 4:621-629, 1992 (Year: 1992).*

Landowski et al., PLoS One 10:e0134723, 2015, 28 pages (Year: 2015).*

"Strategies for Protein Purification Handbook", GE Healthcare, Sep. 2010 (Year: 2010).*

Regado et al., "Flavour development via lipolysis of milkfats: Changes in free fatty acid pool", Int. J. Food Sci. Technol. 42:961-968, 2007 (Year: 2007).*

Pel et al.—Genome sequencing and analysis of the versatile cell factory Aspergillus niger CBS 513.88, Nature Biotechnology, Jan. 28, 2007 (Jan. 28, 2007), vol. 25, pp. 221-231, entire document.

Berka et al.—Comparative genomic analysis of the thermophilic biomass-degrading fungi *Myceliophthora thermophila* and *Thielavia terrestris*, Nature Biotechnology, Oct. 2, 2011 (Oct. 2, 2011), vol. 29, No. 10, pp. 922-927, entire document.

Akoh, C., GDSL family of serine esterases/lipases, 2, Nov. 2004, Prog Lipid Res.

Koschorreck, K., Heterologous expression, characterization and site-directed mutagenesis of cutinase CUTAB1 from Alternaria brassiciola 7, Mar. 20, 2010, Appl Microbiol Biotechnol.

* cited by examiner

 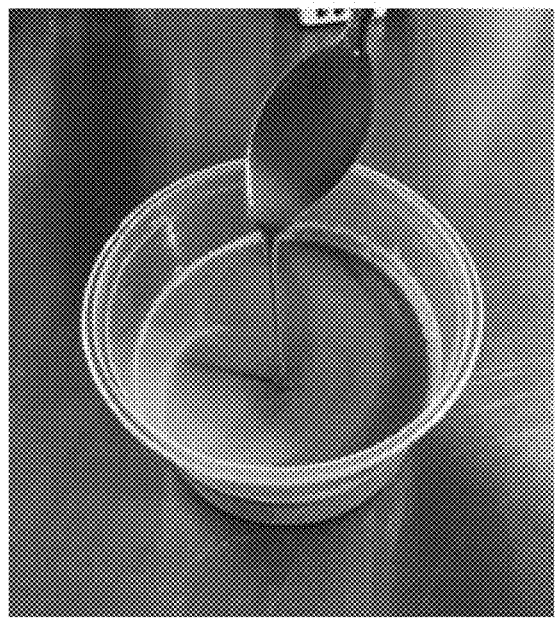
Fig. 9E                         Fig. 9F

RECOMBINANT COMPONENTS AND COMPOSITIONS FOR USE IN FOOD PRODUCTS

RELATED APPLICATIONS

This application is a continuation of U.S. patent application Ser. No. 17/285,589, filed Apr. 15, 2021, which claims the benefit of International Patent application no. PCT/US2019/056703, filed Oct. 17, 2019, which claims the benefit of U.S. Provisional application No. 62/746,918, filed Oct. 17, 2018, each of which is incorporated herein in its entirety.

FIELD OF THE INVENTION

The present invention relates generally to alternatives to animal-derived food products. In particular, the present invention relates to recombinant components and compositions for use in food products, methods for producing these components and compositions, and methods for producing food products comprising these components and compositions.

BACKGROUND OF THE INVENTION

Animal-derived food products (e.g., meat, milk, egg) are popular sources of nutrition. They comprise high-quality protein, essential minerals (e.g., calcium, phosphorus, zinc, magnesium), and vitamins (e.g., riboflavin, vitamin A, vitamin B12). In addition, many such food products possess advantageous functional characteristics that permit production of a wide variety of derivative food products (e.g., yogurt, cheese, cream, ice cream, butter, mayonnaise).

However, animal-derived food products comprise components (e.g., lactose, allergens, saturated fats, cholesterol) that can cause unhealthy reactions in humans. Moreover, production of these food products involves animal husbandry, which has a significant impact on animal welfare and the environment, and which bears the potential for contamination with pathogens, pesticide residues, heavy metals, and aflatoxin M1.

These concerns have fueled development of alternatives to animal-derived food products. Some such alternatives comprise plant-derived components (e.g., proteins, lipids, vitamins). Increasingly, however, alternatives to animal-derived food products are produced from components (e.g., proteins, lipids) that are produced recombinantly (e.g., using microbial host cells).

The use of recombinant components in food products poses new problems. One such problem is the fact that food products produced from recombinant components frequently contain a significant amount of such recombinant components (more than was typical in previous products in which recombinant components were utilized), and that the use of large amounts of recombinant components can be impacted by other, sometimes undesired, components that are simultaneously produced by the microbial host cells from which the recombinant components are obtained.

One such other component is esterase activity. Esterases can hydrolyze ester bonds in diglycerides, triglycerides, phospholipids, and/or lipoproteins to release free fatty acids. Compositions comprising diglycerides, triglycerides, phospholipids, and/or lipoproteins are used in a variety of food products in which recombinant components could be used. In some such food products, the esterase-catalyzed release of free fatty acids can have detrimental effects on properties such as, for example, texture, emulsification, aroma, taste, and nutritional content. In other such food products, the esterase-catalyzed release of free fatty acids can have beneficial effects on properties such as, for example, flavor profiles (e.g., flavor profiles of aged cheese).

As a result, challenges have to be overcome, particularly with respect to esterase activity, in the production, processing, and use of recombinant components for production of alternatives to animal-derived food products.

Therefore, there exists a need for methods by which alternatives to animal-derived food products can be produced from recombinant components, as well as for compositions used in and obtained from such methods.

BRIEF DESCRIPTION OF THE FIGURES

Example embodiments will be described and explained with additional specificity and detail through the use of the accompanying drawings in which:

FIGS. 9A-9F show photographs of gel composition of frozen confections comprising recombinant or native bovine β-lactoglobulin in presence or absence of esterase activity in accordance with various representative embodiments of the present invention.

SUMMARY OF THE INVENTION

Figure 1:
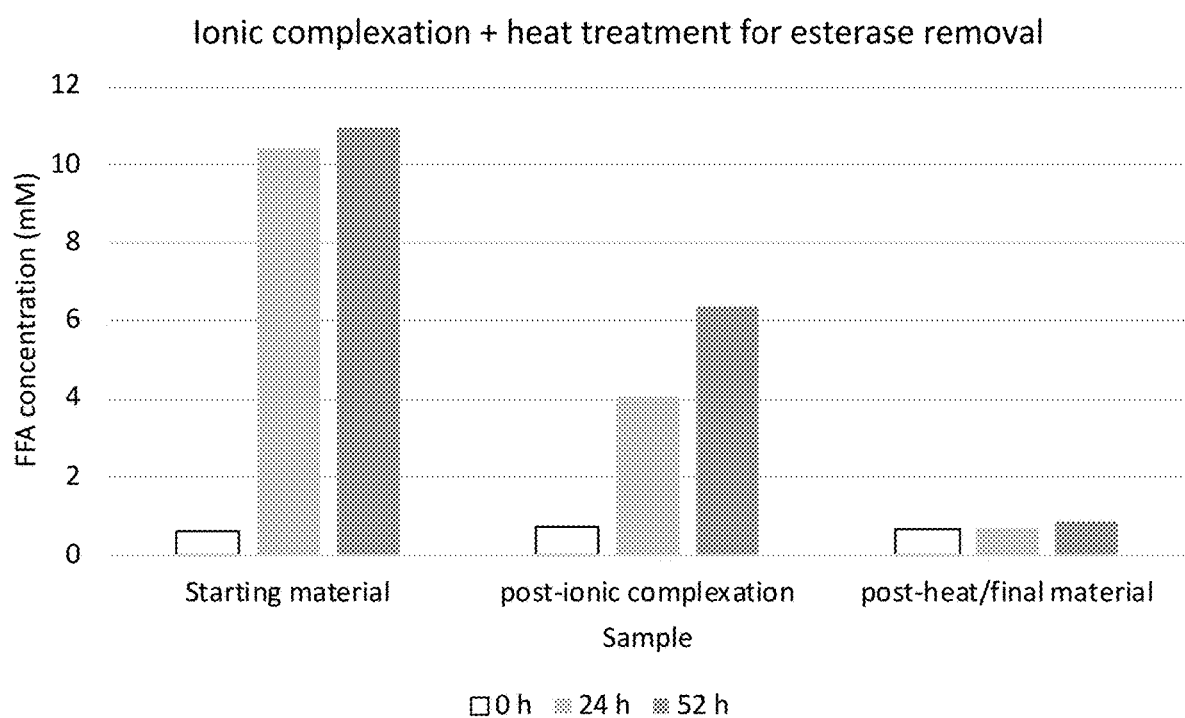
FIG. 1 is a chart showing results of a free fatty acid (FFA) assay of recombinant β-lactoglobulin preparations obtained from purifying away an esterase activity based on charge (i.e., ionic complexation) and thermolability/thermostability, wherein the "final material" is a preparation after buffer exchanges to remove high salt and to concentrate the recombinant β-lactoglobulin, in accordance with various representative embodiments of the present invention.
Figure 2:
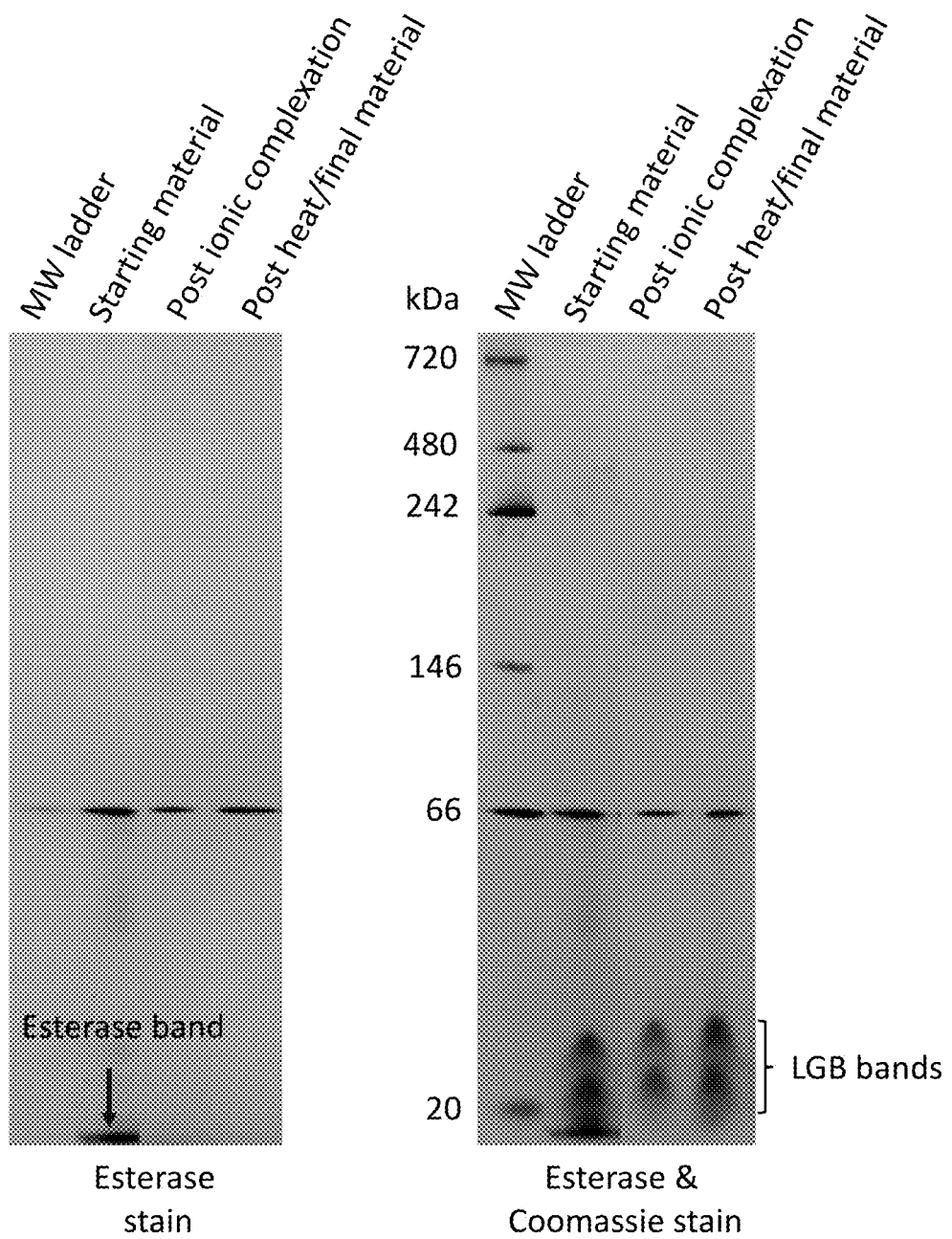
FIG. 2 shows stained native PAGE gels of recombinant β-lactoglobulin preparations obtained from purifying away an esterase activity based on charge (i.e., ionic complexation) and thermolability/thermostability, wherein the "final material" is a preparation after buffer exchanges to remove high salt and to concentrate the recombinant β-lactoglobulin, in accordance with various representative embodiments of the present invention.
Figure 3:
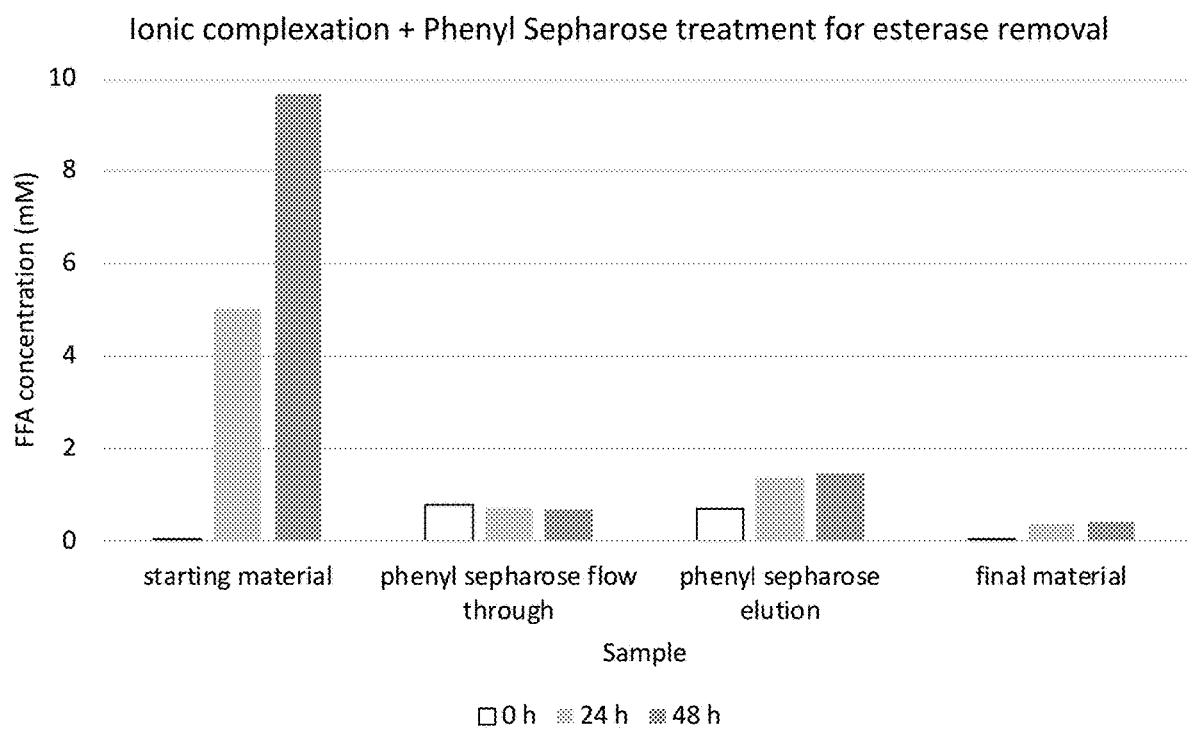
FIG. 3 is a chart showing results of a FFA assay of recombinant β-lactoglobulin preparations obtained from purifying away an esterase activity based on charge (i.e., ionic complexation) and hydrophobicity, wherein the "final material" is a preparation after buffer exchanges to remove high salt and to concentrate the recombinant β-lactoglobulin, in accordance with various representative embodiments of the present invention.
Figure 4:
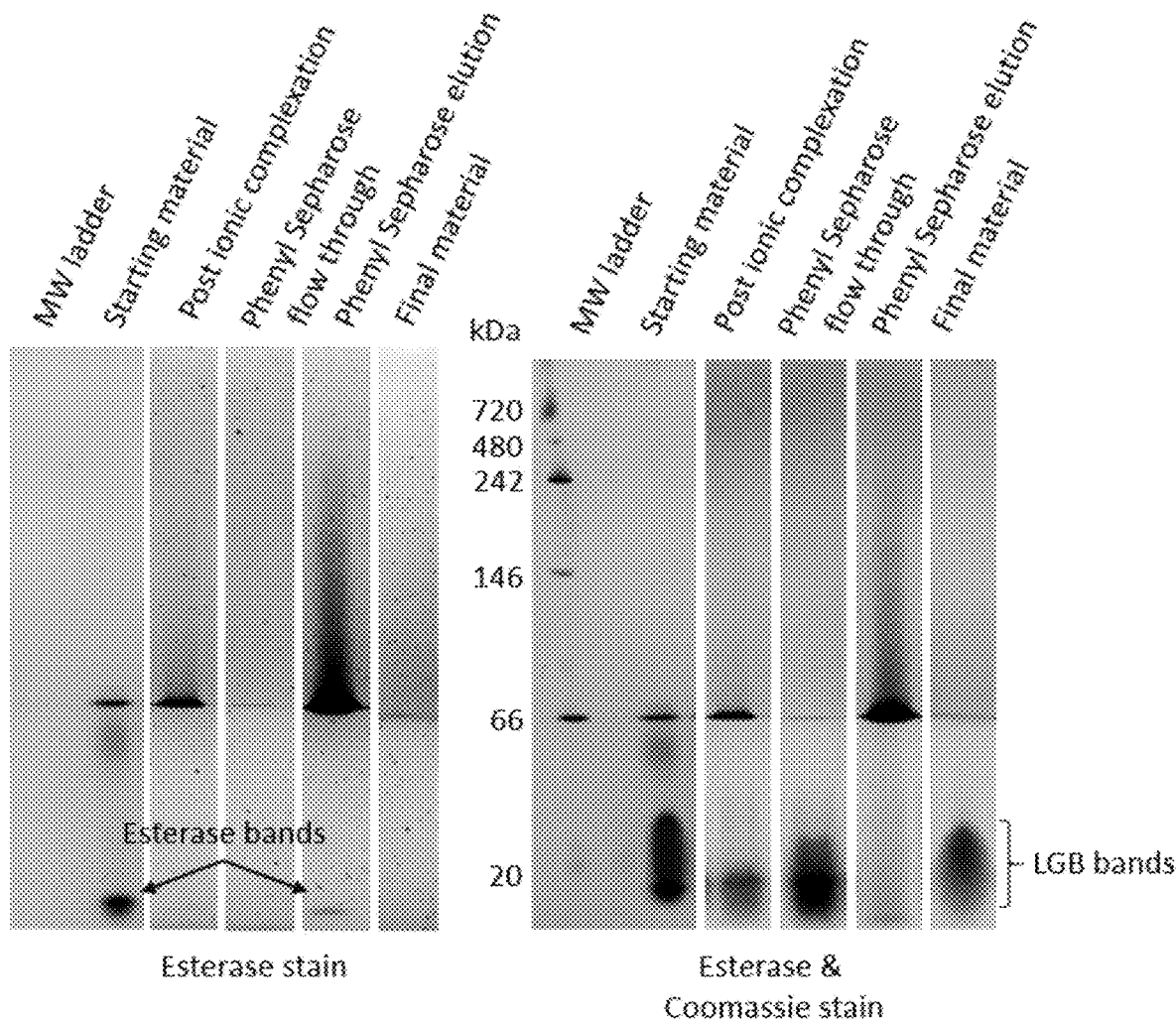
FIG. 4 shows stained native PAGE gels of recombinant β-lactoglobulin preparations obtained from purifying away an esterase activity based on charge (i.e., ionic complexation) and hydrophobicity, wherein the "Final material" is a preparation after buffer exchanges to remove high salt and to concentrate the recombinant β-lactoglobulin, in accordance with various representative embodiments of the present invention.

In one aspect, provided herein is a method for producing a food product comprising a recombinant component produced by a recombinant microbial host cell capable of producing the recombinant component, wherein the method comprises at least one step in which an activity of an esterase is essentially eliminated or modulated.

In another aspect, provided herein is a preparation that comprises a recombinant component and an esterase activity that is essentially eliminated or modulated compared to the esterase activity comprised in a corresponding preparation.

In another aspect, provided herein is a recombinant microbial host cell that is capable of producing a recombinant component and that comprises an essentially eliminated or modulated esterase activity compared to the esterase activity comprised in a corresponding recombinant microbial host cell.

In another aspect, provided herein is a food product that comprises a recombinant component produced by a recombinant microbial host cell, wherein the food product further comprises an essentially eliminated or modulated activity of an esterase compared to the activity of the esterase in a corresponding food product.

DETAILED DESCRIPTION OF THE INVENTION

Unless defined otherwise, all technical and scientific terms used herein have the same meaning as is commonly understood by one of ordinary skill in the art to which this disclosure pertains. Further, unless otherwise required by context, singular terms shall include the plural, and plural terms shall include the singular.

Definitions

The terms "a" and "an" and "the" and similar references as used herein refer to both the singular and the plural, unless otherwise indicated herein or clearly contradicted by context.

The term "about" as used to herein refers to being within an acceptable error range for the particular value as determined by one of ordinary skill in the art, which can depend in part on how the value is measured or determined, or on the limitations of the measurement system.

The term "and/or" as used herein refer to multiple components in combination or exclusive of one another. For example, "x, y, and/or z" can refer to "x" alone, "y" alone, "z" alone, "x, y, and z", "(x and y) or z", or "x or y or z".

The term "corresponding preparation" as used herein refers to a preparation that is identical to the preparation that is compared to the "corresponding preparation" except that the esterase activity comprised in the "corresponding preparation" is not essentially eliminated or modulated as provided herein (e.g., by virtue of the preparation not being derived from a recombinant microbial host cell comprising an essentially eliminated or modulated esterase activity, and/or from a recombinant microbial host cell that was cultured under conditions suitable for essentially eliminating or modulating an esterase activity, and/or from a fermentation broth that comprised an esterase inhibitor; or by virtue of the recombinant component not being purified away from the esterase activity).

The term "corresponding food product" as used herein refers to a food product that is produced by a method that is identical to the method used to produce the food product that is compared to the "corresponding food product" except that the method by which the "corresponding food product" is produced does not comprise at least one step in which an esterase activity is essentially eliminated or modulated as provided in the method provided herein.

The term "corresponding recombinant microbial host cell" refers to a recombinant microbial host cell that is identical to the recombinant microbial host cell that is compared to the "corresponding recombinant microbial host cell" except that the esterase activity of the "corresponding recombinant microbial host cell" is not essentially eliminated or modulated as provided in the recombinant microbial host cell provided herein.

The terms "essentially free of" and "essentially eliminated" as used herein refer to the indicated component being either not detectable in the indicated composition by common analytical methods, or to the indicated component being present in such trace amounts as to not be functional. The term "functional" as used in this context refers to not contributing to properties of the composition comprising the trace amounts of the indicated component, or to not having activity (e.g., enzymatic activity) in the indicated composition comprising the trace amounts of the indicated component, or to not having health-adverse effects upon consumption of the composition comprising the trace amounts of the indicated component.

The terms "esterase activity" or "activity of an esterase" as used herein refer to the activity of an enzyme that can hydrolyze an ester bond (i.e., hydrolase acting on an ester bond). Esterases are designated with enzyme commission number (EC number) 3.1. The terms are used interchangeably herein.

The term "fermentation broth" as used herein refers to a culture comprising a recombinant microbial host cell capable of producing a recombinant component.

The term "filamentous fungal cell" as used herein refers to a cell from any filamentous form of the subdivision Eumycota and Oomycota (as defined by Hawksworth et al., In, Ainsworth and Bisby's Dictionary of The Fungi, 8th edition, 1995, CAB International, University Press, Cambridge, UK). A filamentous fungal cell is distinguished from yeast by its hyphal elongation during vegetative growth.

The term "fungus" as used herein refers to organisms of the phyla Ascomycotas, Basidiomycota, Zygomycota, and Chythridiomycota, Oomycota, and Glomeromycota. It is understood, however, that fungal taxonomy is continually evolving, and therefore this specific definition of the fungal kingdom may be adjusted in the future.

The term "heterologous" as used herein refers to not being normally present in the context in which it is described. In other words, an entity thus characterized is foreign in the context in which it is described. When used in reference to a protein that is produced by a filamentous fungal cell, the term implies that the protein is not natively produced by the filamentous fungal cell.

The term "host cell" as used herein refers to a cell into which a recombinant nucleic acid has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

The term "identical" as used herein in the context of polynucleotide or polypeptide sequences refers to the residues within a reference window in two sequences that are the same when aligned for maximum correspondence. There are a number of different algorithms known in the art that can be used to measure nucleotide sequence or protein sequence identity. For instance, sequences can be compared using FASTA (e.g., as provided in the Wisconsin Genetics Software Package Version 10.0, Genetics Computer Group, Madison, WI), GAP (e.g., as provided in the Wisconsin Genetics Software Package Version 10.0, Genetics Computer Group, Madison, WI), BESTFIT (e.g., as provided in the Wisconsin Genetics Software Package Version 10.0, Genetics Computer Group, Madison, WI), ClustalW (e.g., using default parameters of Version 1.83), or BLAST (e.g., using reciprocal BLAST, PSI-BLAST, BLASTP, BLASTN; e.g., as provided through the National Center for Biotechnology Information) (see, for example, Pearson. 1990. Methods Enzymol. 183:63; Altschul et al. 1990. J. Mol. Biol. 215:403). For alignment by these methods, default parameters may be used (e.g., for BLASTN, the default parameters are Gap opening penalty=5 and Gap extension penalty=2, and for BLASTP, the default parameters are Gap opening penalty=11 and Gap extension penalty=1). The reference window can range from the entire lengths of the 2 sequences to only a region of each of the 2 sequences (e.g., a region that is at least 50 nucleotides or at least 10 amino acids in length).

The terms "including," "includes," "having," "has," "with," or variants thereof as used herein are intended to be inclusive in a manner similar to the term "comprising".

The term "microbe" as used herein is an abbreviation for microorganism, and refers to a unicellular organism. As used herein, the term includes all bacteria, archaea, unicellular protista, unicellular animals, unicellular plants, unicellular fungi, unicellular algae, protozoa, and chromista.

The term "modulated" as used herein in connection with an esterase activity refers to any alteration of an activity of an esterase (e.g., activity of any one esterase disclosed herein or activities of any combination of at least two esterases disclosed herein), including an increase or a decrease of an activity of an esterase. Such modulated esterase activity is typically due either to an increase or decrease of a concentration of an esterase or to an increase or decrease of an enzymatic activity of an esterase.

The term "native" as used herein refers to what is found in nature.

The terms "optional" or "optionally" as used herein refer to a feature or structure being present or not, or an event or circumstance occurring or not. The description includes instances in which a particular feature or structure is present and instances in which the feature or structure is absent, or instances in which the event or circumstance occurs and instances in which the event or circumstance does not occur.

The term "polynucleotide" as disclosed herein refers to both sense and antisense strands of RNA, cDNA, genomic DNA, and synthetic forms and mixed polymers of the above. A polynucleotide may be modified chemically or biochemically or may contain non-natural or derivatized nucleotide bases. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates), charged linkages (e.g., phosphorothioates, phosphorodithioates), pendent moieties (e.g., polypeptides), intercalators (e.g., acridine, psoralen), chelators, alkylators, and modified linkages (e.g., alpha anomeric nucleic acids). Examples of modified nucleotides are are known in the art (see, for example, Malyshev et al. 2014. Nature 509:385; Li et al. 2014. J. Am. Chem. Soc. 136:826). Also included are synthetic molecules that mimic polynucleotides in their ability to bind to a designated sequence via hydrogen bonding and other chemical interactions. Such molecules are known in the art and include, for example, molecules in which peptide linkages substitute for phosphate linkages in the backbone of the molecule. Other modifications can include, for example, analogs in which the ribose ring contains a bridging moiety or other structure such as the modifications found in "locked" polynucleotides.

The term "preparation" as used herein refers to a preparation obtained upon separation of a recombinant component from one or more other components of a fermentation broth.

The term "protein" as used herein refers to a polymeric form of amino acids of any length, which can include coded and non-coded amino acids, amino acids that occur in nature and those that do not occur in nature, chemically or biochemically modified or derivatized amino acids, and polypeptides having modified peptide backbones.

The term "purifying" as used herein refers to a recombinant protein being substantially separated from cellular components (e.g., membrane lipids, chromosomes, proteins) of the recombinant microbial host cell. The term does not require (albeit allows) that the recombinant protein be separated from all other chemicals.

The term "recombinant microbial host cell" as used herein refers to a microbial cell that comprises a recombinant polynucleotide. It should be understood that such term is intended to refer not only to the particular subject cell but also to the progeny of such a cell. Because certain modifications may occur in succeeding generations due to either mutation or environmental influences, such progeny may not be identical to the parent cell, but are still included within the scope of the term "recombinant microbial host cell" as used herein.

The term "recombinant polynucleotide" as used herein refers to a polynucleotide that has been removed from its naturally occurring environment, a polynucleotide that is not associated with all or a portion of a polynucleotide abutting or proximal to the polynucleotide when it is found in nature, a polynucleotide that is operatively linked to a polynucleotide that it is not linked to in nature, or a polynucleotide that does not occur in nature. The term can be used, e.g., to describe cloned DNA isolates, or a polynucleotide comprising a chemically synthesized nucleotide analog. A polynucleotide is also considered "recombinant" if it contains any genetic modification that does not naturally occur. For instance, an endogenous polynucleotide is considered a "recombinant polynucleotide" if it contains an insertion, deletion, or substitution of one or more nucleotides that is introduced artificially, e.g., by human intervention. Such modification can introduce into the polynucleotide a point mutation, substitution mutation, deletion mutation, insertion mutation, missense mutation, frameshift mutation, duplication mutation, amplification mutation, translocation mutation, or inversion mutation. The term includes a polynucleotide in a host cell's chromosome, as well as a polynucleotide that is not in a host cell's chromosome (e.g., a polynucleotide that is comprised in an episome).

The term "recombinant protein" as used herein refers to a protein that is produced in a cell of a different species or type as compared to the species or type of cell that produces the protein in nature, or that is produced in a cell at a level at which it is not produced in nature.

The term "vector" as used herein refers to a nucleic acid molecule capable of transporting another nucleic acid to which it has been linked. One type of vector is a "plasmid," which generally refers to a circular double stranded DNA loop into which additional DNA segments may be ligated, but also includes linear double-stranded molecules such as those resulting from amplification by the polymerase chain reaction (PCR) or from treatment of a circular plasmid with a restriction enzyme. Other vectors include cosmids, bacterial artificial chromosomes (BAC) and yeast artificial chromosomes (YAC). Another type of vector is a viral vector, wherein additional DNA segments may be ligated into the viral genome (discussed in more detail below). Certain vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome.

The term "yeast" as used herein refers to organisms of the order Saccharomycetales, such as *Saccharomyces cerevisiae* and *Pichia pastoris*. Vegetative growth of yeast occurs by budding/blebbing of a unicellular thallus, and carbon catabolism may be fermentative.

Method for Producing Food Product Comprising Recombinant Component

In one aspect, provided herein is a method for producing a food product that comprises a recombinant component (e.g., any of the recombinant components disclosed herein) produced by a recombinant microbial host cell capable of producing the recombinant component (e.g., any of the recombinant microbial host cells provided herein), wherein the method comprises at least one step in which an activity of an esterase (i.e., esterase activity; e.g., activity of any one esterase disclosed herein or activities of any combination of at least two esterases disclosed herein) is essentially eliminated or modulated.

In some embodiments, the present invention provides one or more methods for producing a food product that comprises a recombinant component (e.g., any of the recombinant components disclosed herein) based on the discovery that a recombinant microbial host cell that produces a recombinant component also typically produces an esterase activity. Such esterase activity can co-purify with the recombinant component. When the recombinant component is then used to produce a food product, the esterase activity can hydrolyze ester bonds in diglycerides, triglycerides, phospholipids, and/or lipoproteins contained in the food product, and thus catalyze the production of free fatty acids in the food product.

As noted above, production of free fatty acids in a food product can have detrimental effects, by, for example, producing rancid aroma and/or taste, interfering with formation of emulsions, having undesirable effects on texture, interacting with essential nutrients (e.g., vitamins) and thereby decreasing nutritional content, and reducing shelf-life. Production of free fatty acids in a food product can also have beneficial effects, by, for example, producing desired flavor profiles (e.g., flavor profiles of aged cheese), or making enzyme-modified cheese for use in processed cheese.

In some embodiments, the present invention provides one or more methods for producing a food product that comprises a recombinant component (e.g., any of the recombinant components disclosed herein) based on the discovery that the esterase activity produced by a recombinant host cell differs from the esterase activity contained in mammal-produced milk.

Various embodiments of the present invention therefore include specific methods for essentially eliminating or modulating the esterase activity produced by a recombinant microbial host cell. By essentially eliminating or modulating an esterase activity in a food product comprising a recombinant component produced in a recombinant microbial host cell, the present invention provides a method for preventing or delaying production of rancid aroma and taste, forming emulsions, increasing nutritional content, modulating texture, extending shelf-life, and/or producing more rapidly a desired flavor profile in a food product.

In some embodiments, the method provided herein for producing a food product comprises at least one step in which an esterase activity is essentially eliminated.

In some embodiments, the method provided herein for producing a food product comprises at least one step in which an esterase activity is decreased. In some such embodiments, the esterase activity is decreased by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, at least 97%, at least 98%, at least 99%, or 100%.

In some embodiments, the method provided herein for producing a food product comprises at least one step in which an esterase activity is increased. In some such embodiments, the esterase activity is increased by at least 25%, at least 50%, at least 75%, at least 100%, at least 150%, at least 200%, at least 300%, at least 400%, at least 500%, at least 600%, at least 700%, at least 800%, at least 900%, or at least 1,000%.

In some embodiments, the method provided herein for producing a food product comprises at least one step in which a first esterase activity is essentially eliminated and a second esterase activity is decreased. In some embodiments, the method provided herein for producing a food product comprises at least one step in which a first esterase activity is essentially eliminated and a second esterase activity is increased. In some embodiments, the method provided herein for producing a food product comprises at least one step in which a first esterase activity is increased and a second esterase activity is decreased.

In some embodiments, the method provided herein for producing a food product comprises one step in which an activity of an esterase (e.g., activity of any one esterase disclosed herein or activities of any combination of at least two esterases disclosed herein) is essentially eliminated or modulated.

In some embodiments, the method provided herein for producing a food product comprises two or more steps (e.g., 2 steps, 3 steps, 4 steps, 5 steps) in which an activity of an esterase (e.g., activity of any one esterase disclosed herein or activities of any combination of at least two esterases disclosed herein) is essentially eliminated or modulated (e.g., two or more steps selected from the steps disclosed herein that provide for an essentially eliminated or modulated esterase activity, e.g., activity of any one esterase disclosed herein or activities of any combination of at least two esterases disclosed herein).

Essentially Eliminating or Modulating Esterase Activity

The at least one step in which an esterase activity (e.g., activity of any one esterase disclosed herein or activities of any combination of at least two esterases disclosed herein) is essentially eliminated or modulated in the method provided herein for producing a food product can comprise any step that provides for an essentially eliminated or modulated esterase activity.

In some embodiments, the at least one step in which an esterase activity (e.g., activity of any one esterase disclosed herein or activities of any combination of at least two esterases disclosed herein) is essentially eliminated or modulated in the method provided herein for producing a food product comprises the step of culturing a recombinant microbial host cell capable of producing a recombinant component under conditions suitable for essentially eliminating or modulating the esterase activity.

Accordingly, in some such embodiments, the method provided herein comprises the steps of: a) obtaining a recombinant microbial host cell that is capable of producing a recombinant component (e.g., any of the recombinant components disclosed herein); b) culturing the recombinant microbial host cell in a culture medium under conditions suitable for essentially eliminating or modulating an esterase activity and for production and/or secretion of the recombinant component to obtain a fermentation broth comprising the recombinant component and an essentially eliminated or modulated esterase activity; c) optionally purifying the recombinant component from the fermentation broth to obtain a preparation comprising the recombinant component and an essentially eliminated or modulated esterase activity; and d) preparing a food product from the fermentation broth or preparation comprising the recombinant component and the essentially eliminated or modulated esterase activity.

Suitable conditions for culturing a recombinant microbial host cell in a culture medium under conditions suitable for essentially eliminating or modulating an esterase activity are, for example, those under which the recombinant microbial host cell essentially eliminates or modulates its production of the esterase activity. Non-limiting examples of such conditions include a suitable pH, a suitable temperature, a suitable feed rate, a suitable pressure, a suitable nutrient content (e.g., a suitable carbon content, a suitable nitrogen content, a suitable phosphorus content), a suitable supplement content, a suitable trace metal content, and/or a suitable level of oxygenation. In some embodiments, a suitable pH at which a recombinant microbial host cell essentially eliminates or modulates its production of an esterase activity is a pH of between 2 and 7.5, 6.5, 6, 5, 5, 5, 4.5, 4, 3.5, 3, or 2.5; between 2.5 and 7.5, 6.5, 6, 5, 5, 5, 4.5, 4, 3.5, or 3; between 3 and 7.5, 6.5, 6, 5, 5, 5, 4.5, 4, or 3.5; between 3.5 and 7.5, 6.5, 6, 5, 5, 5, 4.5, 4; between 4 and 7.5, 6.5, 6, 5, 5, 5, 4.5; between 4.5 and 7.5, 6.5, 6, 5, 5, 5; between 5 and 7.5, 6.5, 6, 5, 5; between 5.5 and 7.5, 6.5, 6; between 6 and 7.5, 6.5; between 6.5 and 7.5, or 7; or between 7 and 7.5. In some embodiments, a suitable supplement content in a culture medium in which a recombinant microbial host cell essentially eliminates or modulates its production of an esterase activity is an anti-foam agent. Non-limiting examples of suitable anti-foam agents include Struktol J 673 A (Schill&Seilacher GmbH, Hamburg, Germany), Industrol DF204 (BASF Canada, Inc., Mississauga, Canada), Polyglycol P-2000 (Dow, Midland, MI), Hodag K-60K (Hodag Chemical Corp., Chicago, IL), and Erol DF6000K (PMC Ouvrie, Carvin, France), ACP 1500 (Dow Chemical Company, Midland, MI), Antifoam 204 (Sigma-Aldrich, St Louis, MO), SAG 471 (Momentive Performance Materials Inc., Waterford, NY), SAG 5693 (Momentive Performance Materials Inc., Waterford, NY), SAG 710 (Momentive Performance Materials Inc., Waterford, NY), SAG 730 (Momentive Performance Materials Inc., Waterford, NY), silicone antifoams, Struktol J647 (Schill&Seilacher, Hamburg, Germany), and sunflower oil.

In some embodiments, the at least one step in which an esterase activity (e.g., activity of any one esterase disclosed herein or activities of any combination of at least two esterases disclosed herein) is essentially eliminated or modulated in the method provided herein for producing a food product comprises the step of essentially eliminating or modulating an esterase activity in a fermentation broth or preparation obtained from a culture of a recombinant microbial host cell capable of producing the recombinant component.

Accordingly, in some such embodiments, the method provided herein comprises the steps of: a) obtaining a recombinant microbial host cell that is capable of producing a recombinant component (e.g., any of the recombinant components disclosed herein); b) culturing the recombinant microbial host cell in a culture medium under conditions suitable for production and/or secretion of the recombinant component to obtain a fermentation broth comprising the recombinant component; c) optionally purifying the recombinant component from the fermentation broth to obtain a preparation comprising the recombinant component; d) essentially eliminating or modulating an esterase activity in the fermentation broth or the preparation to obtain a fermentation broth or preparation comprising the recombinant component and an essentially eliminated or modulated esterase activity; and e) preparing a food product from the fermentation broth or preparation comprising the recombinant component and the essentially eliminated or modulated esterase activity.

An esterase activity in a fermentation broth or preparation can be essentially eliminated or modulated, for example, by adding to the fermentation broth or preparation an esterase inhibitor. Non-limiting examples of suitable esterase inhibitors include synthetic inhibitors (e.g., phosphonates, boronic acid, lipid analogues) and natural inhibitors (e.g., β-lactones (such as valilactone, ebelactone A & B, and vibralactone), manno-oligosaccharides, acetylcholine esterase inhibitors, cholinesterase inhibitors, polyphenols, saponins, panclicins, hesperidin, caulerpenyne, proanthocyanidin, Orlistat (Xenical), carnosic acid, escin, crocin, crocetin, chlorogenic acid, neochlorogenic acid, feruloyquinic acid, e-polylysine, chitosan, chitin), isolated, for example, from sources such as *Juniperus communis, Illicium religiosum, Panax japonicus* rhizomes, *Panax ginseng, Panax quinquefolius, Acanthopanax senticosus, Camellia sinensis* var. *sinensis, Camellia sinensis* var. *assamica, Kochia scoparia, Platycodi radix, Salacia reticulate, Nelumbo nucifera, Salix matsudana, Eriochloa villosa, Salacia reticulate, Scabiosa tschiliensis Grun,* and *Acanthopanax* sessiliflorous. In some such embodiments, the esterase inhibitor requires addition of a pH and/or ionic strength adjusting agent for activity.

An esterase activity in a fermentation broth or preparation also can be essentially eliminated or modulated, for example, by removing from and/or adding to the fermentation broth or preparation a cofactor required for activity of an esterase and/or a cofactor required for activity of an esterase inhibitor. Non-limiting examples of such cofactors include metals (e.g., divalent cations, such as calcium). In some embodiments, a divalent cation (e.g., calcium) is removed by binding the divalent cation to a chelating agent. A non-limiting example of a suitable chelating agents is ethylenediaminetetraacetic acid (EDTA).

An esterase activity in a fermentation broth or preparation also can be essentially eliminated or modulated, for example, by thermal or non-thermal processing. Non-limiting examples of thermal processing include pasteurizing and sterilizing. Non-limiting examples of non-thermal processing include high pressure pasteurizing (i.e., high-pressure processing, HPP), ultrasonicating, pulse electric field processing, and irradiating. In some embodiments, an esterase activity in a fermentation broth or preparation is essentially eliminated or reduced by incubating the fermentation broth or preparation at high temperature for a relatively short period of time (e.g., at a temperature of between 85° C. and 90° C. for between 5 and 10 min).

In some embodiments, the at least one step in which an esterase activity (e.g., activity of any one esterase disclosed herein or of any combination of at least two esterase's disclosed herein) is essentially eliminated or modulated in the method provided herein for producing a food product comprises the step of obtaining a recombinant microbial host cell capable of producing a recombinant component, wherein the recombinant microbial host cell comprises an essentially eliminated or modulated esterase activity.

Accordingly, in some such embodiments, the method provided herein comprises the steps of: a) obtaining a recombinant microbial host cell capable of producing a recombinant component (e.g., any of the recombinant components disclosed herein), wherein the recombinant microbial host cell comprises an essentially eliminated or modulated esterase activity compared to the esterase activity comprised in a corresponding recombinant microbial host cell; b) culturing the recombinant microbial host cell in a culture medium under conditions suitable for production and/or secretion of the recombinant component to obtain a fermentation broth comprising the recombinant component and the essentially eliminated or modulated esterase activity; c) optionally purifying the recombinant component from the fermentation broth to obtain a preparation comprising the recombinant component; and d) preparing a food product from the fermentation broth or preparation comprising the recombinant component and the essentially eliminated or modulated esterase activity.

An esterase activity can be essentially eliminated or modulated in a recombinant microbial host cell by essentially eliminating or modulating expression (i.e., production of an active protein) of an esterase (e.g., any one esterase disclosed herein or any combination of at least two esterases disclosed herein), or by essentially eliminating or modulating activity of an esterase. Essentially eliminating or modulating expression of an esterase in a recombinant microbial host cell can be accomplished by, for example, genetically modifying in the recombinant microbial host cell a control sequence (e.g., a promoter sequence, an enhancer sequence, a signal peptide, a transcription terminator, or any other sequence that controls expression (i.e., transcription and/or translation) of a gene), or a functional part thereof (i.e., a part that is sufficient for the function of the control sequence), that drives expression of an esterase such that expression of the esterase is essentially eliminated or modulated.

Essentially eliminating or modulating expression of an esterase in a recombinant microbial host cell can also be accomplished by, for example, genetically modifying in the recombinant microbial host cell a control sequence, or functional part thereof, that drives expression of a protein required for expression of an esterase (e.g., a transcription factor (e.g., a protein that comprises an amino acid sequence that is at least 50% identical (e.g., 50%, 55%, 60%, 65%, 70%, 75%, 80%, 85%, 90%, 91%, 92%, 93%, 94%, 95%, 96%, 97%, 98%, 99%, 99.5%, or more) to a sequence selected from UniProt sequences G0RX49, G0RHG1, A0A2T4B416, A0A2T4BJU6, A2R2J1, A2R903, G2Q2Z5, and G2Q816), a post-translational modification enzyme required for production of an active form of an esterase), or by genetically modifying a coding sequence that encodes a protein required for expression of an esterase, or a functional part thereof (e.g., a DNA binding domain of a transcription factor, a catalytic domain of a post-translational modification enzyme), such that expression of the esterase is essentially eliminated or modulated.

Essentially eliminating or modulating expression of an esterase in a recombinant microbial host cell can also be accomplished by, for example, introducing into the recombinant microbial host cell a recombinant polynucleotide that comprises a nucleotide sequence that is complementary to a coding sequence encoding an esterase, or that encodes a RNAi construct that is specific to an esterase.

Essentially eliminating or modulating expression or activity of an esterase in a recombinant microbial host cell can also be accomplished by, for example, genetically modifying in the recombinant microbial host cell a coding sequence that encodes an esterase or a functional part thereof (e.g., a catalytic domain).

Essentially eliminating or modulating activity of an esterase in a recombinant microbial host cell can also be accomplished by, for example, genetically modifying in the recombinant microbial host cell a control sequence that drives expression of an endogenous inhibitor of an esterase and/or genetically modifying a coding sequence that encodes an endogenous inhibitor of an esterase such that expression and/or activity of the endogenous inhibitor is essentially eliminated or modulated in the recombinant microbial host cell, or by introducing in the recombinant microbial host cell a recombinant polynucleotide that encodes a heterologous inhibitor of an esterase.

The genetically modifying can occur by, for example, introducing, substituting, or removing one or more nucleotides in a nucleotide sequence. For example, one or more nucleotides may be inserted or removed to introduce a stop codon; remove a start codon; insert a frame-shift of the open reading frame; or create a point mutation, missense mutation, substitution mutation, deletion mutation, frameshift mutation, insertion mutation, duplication mutation, amplification mutation, translocation mutation, or inversion mutation.

Methods for genetically modifying a microbial host cell are well known in the art, and include, without limitation, random mutagenesis and screening, site-directed mutagenesis, PCR mutagenesis, insertional mutagenesis, chemical mutagenesis (using, for example, hydroxylamine, N-methyl-N'-nitro-N-nitrosoguanidine (MNNG), N-methyl-N'-nitrosogaunidine (NTG), O-methyl hydroxylamine, nitrous acid, ethyl methane sulphonate (EMS), sodium bisulphite, formic acid, nucleotide analogues), irradiation (e.g., ultraviolet (UV) irradiation), deletion of coding or non-coding nucleotide sequences, homologous recombination, FLP/FRT recombination, gene disruption, CRISPR gene editing, and gene conversion.

In some embodiments, the at least one step in which an esterase activity (e.g., activity of any one esterase disclosed herein or activities of any combination of at least two esterases disclosed herein) is essentially eliminated or modulated in the method provided herein for producing a food product comprises the step of purifying a recombinant component away from an esterase activity produced by a recombinant microbial host cell.

Accordingly, in some such embodiments, the method provided herein comprises the steps of: a) obtaining a recombinant microbial host cell capable of producing a recombinant component (e.g., any of the recombinant components disclosed herein); b) culturing the recombinant microbial host cell in a culture medium under conditions suitable for production and/or secretion of the recombinant component to obtain a fermentation broth comprising the recombinant component; c) purifying the recombinant component from the fermentation broth to obtain a preparation comprising the recombinant component such that the preparation comprises an essentially eliminated or modulated esterase activity; and d) preparing a food product from the preparation comprising the recombinant component and the essentially eliminated or modulated esterase activity.

Purifying a recombinant component from a fermentation broth can be accomplished on the basis of any one property or combination of properties that differentiates the recombinant component from an esterase or that is shared between the recombinant component and an esterase. Non-limiting examples of such properties include size, molecular weight, degradation by a specific protease or combination of proteases, isoelectric point (pI), charge, thermolability/thermostability, affinity for a specific molecule, solubility, pH stability, hydrophobicity, and hydrophilicity.

In some embodiments, the recombinant component is purified on the basis of thermolability/thermostability. In some such embodiments, a fermentation broth (e.g., a clarified fermentation broth (i.e., a fermentation broth from which cells and cell debris were removed)) or preparation comprising the recombinant component is heated to a temperature at which an esterase is denatured and precipitates out of solution but at which the recombinant component remains structurally intact and soluble. The precipitated esterase can subsequently be separated from the soluble recombinant component by any suitable method, including 1-g sedimentation, accelerated sedimentation via centrifugation, and/or a variety of filtration techniques, including but not limited to depth filtration or tangential flow filtration, using filter pads, sheets, or membranes.

In some embodiments, the recombinant component is purified on the basis of hydrophobicity. In some such embodiments, a suitable chromatographic support is added to a fermentation broth (e.g., a clarified fermentation broth) or preparation comprising the recombinant component, and the pH and/or ionic strength of the fermentation broth or preparation is adjusted such that the esterase or the recombinant component (but not both) binds to the chromatographic support (e.g., based on hydrophobic interaction), leaving behind the soluble recombinant component or esterase in an unbound portion, respectively. Non-limiting examples of suitable chromatographic supports include phenyl sepharose, butyl sepharose, and octyl sepharose. The chromatographic support with bound esterase or recombinant component can subsequently be separated from the soluble recombinant component or esterase, respectively, by any suitable method known in the art, including but not limited to 1-g sedimentation, centrifugation, or filtration. Alternatively, the chromatographic support can be a stationary support (e.g., adsorbent in a column) through which the fermentation broth or preparation comprising the recombinant component is made to travel, and the recombinant component is obtained in the unbound portion whereas the esterase binds to the chromatographic support, or the recombinant component is bound to the chromatographic support whereas and the esterase remains in the unbound portion, and the bound recombinant component is subsequently released from the chromatograph support, by, for example, adjusting the pH and/or ionic strength.

In some embodiments, the recombinant component is purified on the basis of charge. In some such embodiments, a counterion or ion-exchange resin or sodium acid salt is added to a fermentation broth (e.g., a clarified fermentation broth) or preparation comprising the recombinant component, and the pH and/or ionic strength of the fermentation broth or preparation is adjusted such that the counterion or ion-exchange resin or sodium acid salt forms a complex with the recombinant component or the esterase, leaving behind a soluble esterase or recombinant component, respectively. The complex can subsequently be isolated by any suitable method known in the art, including including 1-g sedimentation, accelerated sedimentation via centrifugation, and/or a variety of filtration techniques, including but not limited to depth filtration or tangential flow filtration, using filter pads, sheets, or membranes. In embodiments in which the recombinant component is complexed to the counterion or ion-exchange resin or sodium acid salt, the recombinant component can be extracted from the complex by adjusting the pH and/or ionic strength such that the recombinant component and the counterion or ion-exchange resin or sodium acid salt repel each other.

In some embodiments, the recombinant component is purified on the basis of pH stability. In some such embodiments, the pH of a fermentation broth (e.g., a clarified fermentation broth) or preparation comprising the recombinant component is adjusted such that an esterase is denatured and precipitates out of solution, leaving behind soluble recombinant component. The precipitated esterase can subsequently be separated from the soluble recombinant component by any suitable method, including but not limited to 1-g sedimentation, accelerated sedimentation via centrifugation, and/or a variety of filtration techniques, including but not limited to depth filtration or tangential flow filtration, using filter pads, sheets, or membranes.

In some embodiments, the recombinant component is purified on the basis of two or more of charge, thermolability/thermostability, hydrophobicity, size, molecular weight, pH stability, isoelectric point (pI), affinity for a specific molecule, and solubility, wherein the various strategies for separation are performed in succession (e.g., separation based on charge followed by separation based on hydrophobicity, separation based on hydrophobicity followed by separation based on pH stability) or in parallel (e.g., separation based on pH stability and thermolability/thermostability, separation based on pH stability and affinity to a specific molecule, separation based on solubility and pH stability and/or thermolability/thermostability and/or pI).

Esterase Activity

An essentially eliminated or modulated esterase activity as provided herein (e.g., an essentially eliminated or modulated esterase activity comprised in a fermentation broth or preparation comprising a recombinant component, or comprised in a recombinant microbial host cell provided herein capable of producing a recombinant component) can be an essentially eliminated or modulated activity of any one esterase or of any combination of at least two (e.g., at least 2, at least 3, at least 4, at least 5, at least 6, at least 7, at least 8, at least 9, at least 10, at least 11, at least 12, or more) esterases.

Non-limiting examples of such esterases include carboxylic ester hydrolases (EC number 3.1.1), phosphoric diester hydrolases (EC number 3.1.4), exoribonucleases (EC number 3.1.13), carboxylesterases (EC number 3.1.1.1), arylesterases (EC number 3.1.1.2), triacylglycerol lipases (EC number 3.1.1.3), phospholipases A2 (EC number 3.1.1.4), lysophospholipases (EC number 3.1.1.5), acetylesterases (EC number 3.1.1.6), acetylcholinesterases (EC number 3.1.1.7), phospholipases C (EC number 3.1.4.3), phospholipases D (EC number 3.1.4.4), phosphoinositide phospholipases C (3.1.4.11), pectinesterases (EC number 3.1.1.11), gluconolactonases (EC number 3.1.1.17), acylglycerol lipases (EC number 3.1.1.23), 3-oxoadipate enol-lactonases (EC number 3.1.1.24), 1,4-lactonases (EC number 3.1.1.25), galactolipases (EC number 3.1.1.26), phospholipases A1 (EC number 3.1.1.32), lipoprotein lipases (EC number 3.1.1.34), cephalosporin-C deacetylases (EC number 3.1.1.41), carboxymethylenebutenolidases (EC number 3.1.1.45), 2-pyrone-4,6-dicarboxylate lactonases (EC number 3.1.1.57), feruloyl esterases (EC number 3.1.1.73), cutinases (EC number 3.1.1.74), and hormone-sensitive lipases (EC number 3.1.1.79).

Non-limiting examples of suitable carboxylic ester hydrolases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a carboxylic ester hydrolase listed in Table 1.

TABLE 1

Exemplary Esterases (UniProt Sequence IDs)

| | | | | | |
|---|---|---|---|---|---|
| G0RX49 | G0RWS1 | G0RKL4 | A2QLA0 | G0RBZ6 | G0RIU1 |
| G0RHG1 | A2QT90 | G0RJ76 | A2QZX4 | G0RJC6 | A2R6L8 |
| A2R2J1 | A2QF42 | A2QFE9 | A2R2I5 | G0RQN5 | G0RX90 |
| A2R903 | A2R350 | A2QZN6 | A2QI32 | G0RGQ7 | G0RLB7 |
| A0A2T4B416 | A2QKQ5 | A2QG33 | A2QIR3 | A2QEJ2 | G0RLB0 |
| G2Q2Z5 | A2R7J0 | A5ABE5 | A2QH76 | A2QRK1 | A2QNF0 |
| G2Q8I6 | E2PT14 | A2Q8F7 | A2R5R5 | G0REM9 | G0RBM4 |
| A0A2T4BJU6 | A2QCM0 | A2QF54 | E2PT22 | G0RAQ0 | A0A2T4AZ21 |
| G0RWC3 | A2QII0 | A2QBG8 | A2R502 | G0RTR6 | A0A2T4BBP9 |
| G0RMN0 | A2QUA5 | A2R2M3 | A2R496 | G0RLF5 | G2Q379 |
| G0R9X3 | A2R088 | A2QZ72 | A5ABH9 | G0RDK5 | G0RMI7 |
| G0RVK4 | G0RRK3 | A2RAP4 | A2R1N7 | G0RBJ0 | A2R689 |
| G0RCG3 | G0RGR3 | A2QS46 | A2QS22 | G0RMI3 | A2QMI7 |
| G0RVN2 | A2QT70 | A2QCT1 | A2QUC1 | G0R707 | A2QT47 |
| G0R6X2 | A2QPJ6 | A2R032 | A2R273 | G0RBB4 | A2QS21 |
| G0R8N5 | A2QSJ9 | A2R9C0 | A2QBH3 | G0RJY0 | A2QZE3 |
| A2QW83 | A2QST4 | A5ABC3 | A2QH22 | G0RT28 | A2R8R3 |
| A2Q9L0 | A2R6I6 | A2R8Z3 | A5ABE8 | A2QE05 | A2R1R5 |
| A2QRP8 | A2QSX2 | A2QE77 | A2QHE2 | A2QPY4 | A2QUQ1 |
| A2R0H9 | A2QS66 | A5ABK1 | A2QK90 | A2R8R4 | A2QVF5 |
| A2R7H4 | A2QZY6 | A2QX56 | A2QMK5 | A2R234 | A2R4Z2 |
| A2QUD7 | A2R5V7 | A2QYS7 | A2QZ17 | A0A2T4BJD9 | A2QNW9 |
| A2R780 | A2QF64 | A2R835 | A2Q8R7 | A0A2T4BFY3 | A2R1P3 |
| E2PSR0 | A2QM14 | A2QT75 | A2QZW3 | G2QL32 | A2QYC0 |
| A5ABE6 | A2QGD9 | A2QBH5 | A2QAH7 | A0A2T4BNI9 | A2QYK5 |
| A2R2W3 | A2QN29 | A2QS33 | A2QIA0 | A2QPC2 | A2QZB7 |
| A2QBP1 | A2QTI0 | A2R274 | A2QUE3 | A0A2T4BCL7 | A2QK82 |
| G0RH85 | A2R199 | A2QEW9 | A2QIE4 | A2QY19 | A2QHB7 |
| G2QH51 | A2QTZ0 | A5ABC0 | A2QN56 | A2QAD7 | A2QZR0 |
| A0A2T4BJB5 | A2R775 | A2QW25 | A2Q818 | A2QVJ4 | A2QC75 |
| A2QSY5 | A2QHE9 | A2QS56 | A2QV39 | A2R256 | G2Q0K1 |
| A2R0Z6 | A2R1X8 | A2QRK3 | A2QV40 | A2R5R4 | A0A2T4B235 |
| A2QYU7 | A2R709 | A2QG70 | A2R6H5 | A2RBF9 | G0RHJ4 |
| A2QZI3 | A2QTI9 | A2QZK9 | A2QBC9 | A2QXD2 | A2QEH4 |
| A2QT66 | A2QL90 | A2QV44 | A2QV27 | A2R098 | A2R845 |
| A2QYF0 | A5ABZ1 | A2QZB2 | A2QT57 | A2QL89 | A2QAC4 |
| A2QX92 | A2QKZ8 | A2QBK3 | A2QBH8 | A2R8M8 | A2R6I8 |
| A2QK84 | A2R8C2 | A2R0P4 | A2Q8U6 | A2QZX0 | |

In some embodiments, the carboxylic ester hydrolase comprises an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from UniProt sequences G0RIU1, A2R1N7, G0RBM4, A0A2T4BBP9, G2Q379, A0A2T4AZ21, A2R8Z3, G0R9X3, A2QPC2, G0RCG3, A0A2T4BCL7, A0A2T4B416, and A0A2T4BNI9.

Non-limiting examples of suitable phosphoric diester hydrolases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a phosphoric diester hydrolase listed in Table 1.

Non-limiting examples of suitable exoribonucleases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a exoribonuclease listed in Table 1.

Non-limiting examples of suitable carboxylesterases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a carboxylesterase listed in Table 1.

Non-limiting examples of suitable arylesterases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a arylesterase listed in Table 1.

Non-limiting examples of suitable triacylglycerol lipases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a triacylglycerol lipase listed in Table 1. In some embodiments, the triacylglycerol lipase comprises an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from UniProt sequences A2QM14 and A2R709.

Non-limiting examples of suitable phospholipases A2 include esterases that comprise an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from any of the sequences encoding a phospholipase A2 listed in Table 1.

Non-limiting examples of suitable lysophospholipases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a lysophospholipase listed in Table 1. In some embodiments, the lysophospholipase comprises an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from UniProt sequences G0RX90, G2Q0K1, A0A2T4B235, A2QC75, and A2QF42.

Non-limiting examples of suitable acetylesterases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding an acetylesterase listed in Table 1. In some embodiments, the acetylesterase comprises an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from UniProt sequences G0RHJ4, A0A2T4BJD9, and G2QL32.

Non-limiting examples of suitable acetylcholinesterases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a acetylcholinesterase listed in Table 1.

Non-limiting examples of suitable phospholipases C include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a phospholipase C listed in Table 1. In some embodiments, the phospholipase C comprises an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from UniProt sequences G0REM9, A0A2T4BFY3, and A2QAD7.

Non-limiting examples of suitable phospholipases D include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a phospholipase D listed in Table 1.

Non-limiting examples of suitable phosphoinositide phospholipases C include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a phosphoinositide phospholipase C listed in Table 1.

Non-limiting examples of suitable pectinesterases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a pectinesterase listed in Table 1.

Non-limiting examples of suitable gluconolactonases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a gluconolactonase listed in Table 1.

Non-limiting examples of suitable acylglycerol lipases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a acylglycerol lipase listed in Table 1.

Non-limiting examples of suitable 3-oxoadipate enol-lactonases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a 3-oxoadipate enol-lactonase listed in Table 1.

Non-limiting examples of suitable 1,4-lactonases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a 1,4-lactonase listed in Table 1.

Non-limiting examples of suitable galactolipases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a galactolipase listed in Table 1.

Non-limiting examples of suitable phospholipases A1 include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a phospholipase A1 listed in Table 1.

Non-limiting examples of suitable lipoprotein lipases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a lipoprotein lipase listed in Table 1.

Non-limiting examples of suitable cephalosporin-C deacetylases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a cephalosporin-C deacetylase listed in Table 1.

Non-limiting examples of suitable carboxymethylenebutenolidases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a carboxymethylenebutenolidase listed in Table 1.

Non-limiting examples of suitable 2-pyrone-4,6-dicarboxylate lactonases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a 2-pyrone-4,6-dicarboxylate lactonase listed in Table 1.

Non-limiting examples of suitable feruloyl esterases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a feruloyl esterase listed in Table 1.

Non-limiting examples of suitable cutinases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a cutinase listed in Table 1. In some embodiments, the cutinase comprises an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from UniProt sequences G0RH85, A2QBP1, A0A2T4BJB5, A5ABE6, A2R2W3, and G2QH51.

Non-limiting examples of suitable hormone-sensitive lipases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence selected from any of the sequences encoding a hormone-sensitive lipase listed in Table 1.

Non-limiting examples of additional suitable esterases include esterases that comprise an amino acid sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% identical to a sequence listed in Table 1, and esterases that comprise an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to any one of the InterPro domains listed in Table 2.

TABLE 2

InterPro Numbers of Exemplary Esterase Catalytic Domains

| | | | | |
|---|---|---|---|---|
| IPR002168 | IPR017915 | IPR003187 | IPR038885 | IPR008265 |
| IPR033140 | IPR001087 | IPR004961 | IPR039097 | IPR033112 |
| IPR000675 | IPR001531 | IPR007000 | IPR039180 | IPR033113 |
| IPR002641 | IPR003633 | IPR007942 | IPR008947 | IPR001423 |
| IPR002642 | IPR007751 | IPR009613 | IPR036541 | IPR009535 |
| IPR002921 | IPR008475 | IPR010711 | IPR033560 | IPR026605 |
| IPR001711 | IPR010468 | IPR011402 | IPR033562 | IPR028382 |
| IPR001736 | IPR013818 | IPR012354 | IPR033902 | IPR028407 |
| IPR000909 | IPR014815 | IPR016272 | IPR034315 | IPR032075 |
| IPR005592 | IPR015359 | IPR016338 | IPR037737 | IPR032588 |
| IPR006693 | IPR016090 | IPR016445 | IPR038875 | IPR033556 |
| IPR025202 | IPR017913 | IPR016674 | IPR001211 | IPR033903 |
| IPR003140 | IPR017914 | IPR017186 | IPR001981 | IPR033906 |
| IPR011150 | IPR024632 | IPR017766 | IPR002330 | IPR035547 |
| IPR015679 | IPR025920 | IPR017767 | IPR002331 | IPR035669 |
| IPR016555 | IPR029002 | IPR017769 | IPR002333 | IPR000734 |
| IPR021771 | IPR032093 | IPR020009 | IPR002334 | IPR001028 |
| IPR001192 | IPR032341 | IPR025483 | IPR036444 | IPR036691 |
| IPR024884 | IPR016035 | IPR002918 | IPR005152 | IPR015141 |

The esterases disclosed herein include esterases that are conservatively modified variants of the esterases disclosed herein. The term "conservatively modified variants" as used herein refers to an individual substitution, deletion, or addition to an encoded amino acid sequence that results in the substitution of an amino acid with a chemically similar amino acid. Conservative substitution tables providing functionally similar amino acids are well known in the art. The esterases disclosed herein further include polymorphic variants, interspecies homologs, and alleles of the esterases disclosed herein.

In embodiments in which the essentially eliminated or modulated esterase activity (e.g., the essentially eliminated or modulated esterase activity comprised in a fermentation broth or preparation provided herein comprising a recombinant component, or in a recombinant microbial host cell provided herein capable of producing a recombinant component) comprises an essentially eliminated or modulated activity of at least two esterases, such at least two esterases can comprise one or more (e.g., two or more, three or more, four or more, five or more, six or more, seven or more, eight or more, nine or more, ten or more, eleven or more, twelve or more, etc.) of any esterase (e.g., any esterase provided herein).

Non-limiting examples of such esterases include carboxylic ester hydrolases (EC number 3.1.1), phosphoric diester hydrolases (EC number 3.1.4), exoribonucleases (EC number 3.1.13), carboxylesterases (EC number 3.1.1.1), arylesterases (EC number 3.1.1.2), triacylglycerol lipases (EC number 3.1.1.3), phospholipases A2 (EC number 3.1.1.4), lysophospholipases (EC number 3.1.1.5), acetylesterases (EC number 3.1.1.6), acetylcholinesterases (EC number 3.1.1.7), phospholipases C (EC number 3.1.4.3), phospholipases D (EC number 3.1.4.4), phosphoinositide phospholipases C (3.1.4.11), pectinesterases (EC number 3.1.1.11), gluconolactonases (EC number 3.1.1.17), acylglycerol lipases (EC number 3.1.1.23), 3-oxoadipate enol-lactonases (EC number 3.1.1.24), 1,4-lactonases (EC number 3.1.1.25), galactolipases (EC number 3.1.1.26), phospholipases A1 (EC number 3.1.1.32), lipoprotein lipases (EC number 3.1.1.34), cephalosporin-C deacetylases (EC number 3.1.1.41), carboxymethylenebutenolidases (EC number 3.1.1.45), 2-pyrone-4,6-dicarboxylate lactonases (EC number 3.1.1.57), feruloyl esterases (EC number 3.1.1.73), cutinases (EC number 3.1.1.74), hormone-sensitive lipases (EC number 3.1.1.79), and combinations thereof.

Non-limiting examples of such combinations thereof include: one or more cutinases and one or more other carboxylic ester hydrolases; one or more lysophospholipases and one or more other carboxylic ester hydrolases; one or more triacylglycerol lipases and one or more other carboxylic ester hydrolases; one or more phospholipases A2 and one or more other carboxylic ester hydrolases; one or more phospholipases C and one or more other carboxylic ester hydrolases; one or more acetylxylanesterase and one or more other carboxylic ester hydrolases; one or more extracellular lipase-like proteins and one or more other carboxylic ester hydrolases; one or more acetylesterases and one or more other carboxylic ester hydrolases; one or more GDSL lipases and one or more other carboxylic ester hydrolases; one or more alpha/beta hydrolases and one or more other carboxylic ester hydrolases; one or more transcription factors regulating expression of an esterase and one or more other carboxylic ester hydrolases; one or more cutinases and one or more lysophospholipases; one or more cutinases and one or more triacylglycerol lipases; one or more cutinases and one or more phospholipases A2; one or more cutinases and one or more phospholipases C; one or more cutinases and one or more acetylxylanesterases; one or more cutinases and one or more extracellular lipase-like proteins; one or more cutinases and one or more acetylesterases; one or more cutinases and one or more GDSL lipases; one or more cutinases and one or more alpha/beta hydrolases; one or more cutinases and one or more transcription factors regulating expression of an esterase; one or more lysophospholipases and one or more triacylglycerol lipases; one or more lysophospholipases and one or more phospholipases A2; one or more lysophospholipases and one or more phospholipases C; one or more lysophospholipases and one or more acetylxylanesterases; one or more lysophospholipases and one or more extracellular lipase-like proteins; one or more lysophospholipases and one or more acetylesterases; one or more lysophospholipases and one or more GDSL lipases; one or more lysophospholipases and one or more alpha/beta hydrolases; one or more lysophospholipases and one or more transcription factors regulating expression of an esterase; one or more triacylglycerol lipases and one or more phospholipases A2; one or more triacylglycerol lipases and one or more phospholipases C; one or more triacylglycerol lipases and one or more acetylxylanesterases; one or more triacylglycerol lipases and one or more extracellular lipase-like proteins; one or more triacylglycerol lipases and one or more acetylesterases; one or more triacylglycerol lipases and one or more GDSL lipases; one or more triacylglycerol lipases and one or more alpha/beta hydrolases; one or more triacylglycerol lipases and one or more transcription factors regulating expression of an esterase; one or more phospholipases A2 and one or more phospholipases C; one or more phospholipases A2 and one or more acetylxylanesterases; one or more phospholipases A2 and one or more extracellular lipase-like proteins; one or more phospholipases A2 and one or more acetylesterases; one or more phospholipases A2 and one or more GDSL lipases; one or more phospholipases A2 and one or more alpha/beta hydrolases; one or more phospholipases A2 and one or more transcription factors regulating expression of an esterase; one or more phospholipases C and one or more acetylxylanesterases; one or more phospholipases C and one or more extracellular lipase-like proteins; one or more phospholipases C and one or more acetylesterases; one or more phospholipases C and one or more GDSL lipases; one or more phospholipases C and one or more alpha/beta hydrolases; one or more phospholipases C and one or more transcription factors regulating expression of an esterase; one or more acetylxylanesterase and one or more extracellular lipase-like proteins; one or more acetylxylanesterase and one or more acetylesterases; one or more acetylxylanesterase and one or more GDSL lipases; one or more acetylxylanesterase and one or more alpha/beta hydrolases; one or more acetylxylanesterase and one or more transcription factors regulating expression of an esterase; one or more acetylesterases and one or more GDSL lipases; one or more acetylesterases and one or more alpha/beta hydrolases; one or more acetylesterases and one or more transcription factors regulating expression of an esterase; one or more GDSL lipases and one or more alpha/beta hydrolases; one or more GDSL lipases and one or more transcription factors regulating expression of an esterase; one or more alpha/beta hydrolases and one or more transcription factors regulating expression of an esterase; one or more cutinases and one or more lysophospholipases and one or more other carboxylic ester hydrolases; one or more cutinases and one or more triacylglycerol lipases and one or more other carboxylic ester hydrolases; one or more cutinases and one or more phospholipases A2 and one or more other carboxylic ester hydrolases; one or more cutinases and one or more phospholipases C and one or more other carboxylic ester hydrolases; one or more cutinases and one or more acetylxylanesterases and one or more other carboxylic ester hydrolases; one or more cutinases and one or more extracellular lipase-like proteins and one or more other carboxylic ester hydrolases; one or more cutinases and one or more acetylesterases and one or more other carboxylic ester hydrolases; one or more cutinases and one or more GDSL lipases and one or more other carboxylic ester hydrolases; one or more cutinases and one or more alpha/beta hydrolases and one or more other carboxylic ester hydrolases; one or more cutinases and one or more transcription factors regulating expression of an esterase and one or more other carboxylic ester hydrolases; one or more lysophospholipases and one or more triacylglycerol lipases and one or more other carboxylic ester hydrolases; one or more lysophospholipases and one or more phospholipases A2 and one or more other carboxylic ester hydrolases; one or more lysophospholipases and one or more phospholipases C and one or more other carboxylic ester hydrolases; one or more lysophospholipases and one or more acetylxylanesterases and one or more other carboxylic ester hydrolases; one or more lysophospholipases and one or more extracellular lipase-like proteins; one or more lysophospholipases and one or more acetylesterases and one or more other carboxylic ester hydrolases; one or more lysophospholipases and one or more GDSL lipases and one or more other carboxylic ester hydrolases; one or more lysophospholipases and one or more alpha/beta hydrolases and one or more other carboxylic ester hydrolases; one or more lysophospholipases and one or more transcription factors regulating expression of an esterase and one or more other carboxylic ester hydrolases; one or more triacylglycerol lipases and one or more phospholipases A2 and one or more other carboxylic ester hydrolases; one or more triacylglycerol lipases and one or more phospholipases C and one or more other carboxylic ester hydrolases; one or more triacylglycerol lipases and one or more acetylxylanesterases and one or more other carboxylic ester hydrolases; one or more triacylglycerol lipases and one or more extracellular lipase-like proteins and one or more other carboxylic ester hydrolases; one or more triacylglycerol lipases and one or more acetylesterases and one or more other carboxylic ester hydrolases; one or more triacylglycerol lipases and one or more GDSL lipases and one or more other carboxylic ester hydrolases; one or more triacylglycerol lipases and one or more alpha/beta hydrolases and one or more other carboxylic ester hydrolases; one or more triacylglycerol lipases and one or more transcription factors regulating expression of an esterase and one or more other carboxylic ester hydrolases; one or more phospholipases A2 and one or more phospholipases C and one or more other carboxylic ester hydrolases; one or more phospholipases A2 and one or more acetylxylanesterase and one or more other carboxylic ester hydrolases; one or more phospholipases A2 and one or more extracellular lipase-like proteins and one or more other carboxylic ester hydrolases; one or more phospholipases A2 and one or more acetylesterases and one or more other carboxylic ester hydrolases; one or more phospholipases A2 and one or more GDSL lipases, and one or more other carboxylic ester hydrolases; one or more phospholipases A2 and one or more alpha/beta hydrolases and one or more other carboxylic ester hydrolases; one or more phospholipases A2 and one or more transcription factors regulating expression of an esterase and one or more other carboxylic ester hydrolases; one or more phospholipases C and one or more acetylxylanesterase and one or more other carboxylic ester hydrolases; one or more phospholipases C and one or more extracellular lipase-like proteins; one or more phospholipases C and one or more acetylesterases and one or more other carboxylic ester hydrolases; one or more phospholipases C and one or more GDSL lipases and one or more other carboxylic ester hydrolases; one or more phospholipases C and one or more alpha/beta hydrolases and one or more other carboxylic ester hydrolases; one or more phospholipases C and one or more transcription factors regulating expression of an esterase and one or more other carboxylic ester hydrolases; one or more acetylxylanesterase and one or more extracellular lipase-like proteins and one or more other carboxylic ester hydrolases; one or more acetylxylanesterase and one or more acetylesterases and one or more other carboxylic ester hydrolases; one or more acetylxylanesterase and one or more GDSL lipases and one or more other carboxylic ester hydrolases; one or more acetylxylanesterase and one or more alpha/beta hydrolases and one or more other carboxylic ester hydrolases; one or more acetylxylanesterase and one or more transcription factors regulating expression of an esterase and one or more other carboxylic ester hydrolases; one or more acetylesterases and one or more GDSL lipases and one or more other carboxylic ester hydrolases; one or more acetylesterases and one or more alpha/beta hydrolases and one or more other carboxylic ester hydrolases; one or more acetylesterases and one or more transcription factors regulating expression of an esterase and one or more other carboxylic ester hydrolases; one or more GDSL lipases and one or more alpha/beta hydrolases and one or more other carboxylic ester hydrolases; one or more GDSL lipases and one or more transcription factors regulating expression of an esterase and one or more other carboxylic ester hydrolases; one or more alpha/beta hydrolases and one or more transcription factors regulating expression of an esterase and one or more other carboxylic ester hydrolases; one or more cutinases and one or more lysophospholipases and one or more triacylglycerol lipases; one or more cutinases and one or more lysophospholipases and one or more phospholipases A2; one or more cutinases and one or more lysophospholipases and one or more phospholipases C; one or more cutinases and one or more lysophospholipases and one or more acetylxylanesterases; one or more cutinases and one or more lysophospholipases and one or more extracellular lipase-like proteins; one or more cutinases and one or more lysophospholipases and one or more acetylesterases; one or more cutinases and one or more lysophospholipases and one or more GDSL lipases; one or more cutinases and one or more lysophospholipases and one or more alpha/beta hydrolases; one or more cutinases and one or more lysophospholipases and one or more transcription factors regulating expression of an esterase; one or more cutinases and one or more triacylglycerol lipases and one or more phospholipases A2; one or more cutinases and one or more triacylglycerol lipases and one or more phospholipases C; one or more cutinases and one or more triacylglycerol lipases and one or more acetylxylanesterases; one or more cutinases and one or more triacylglycerol lipases and one or more extracellular lipase-like proteins; one or more cutinases and one or more triacylglycerol lipases and one or more acetylesterases; one or more cutinases and one or more triacylglycerol lipases and one or more GDSL lipases; one or more cutinases and one or more triacylglycerol lipases and one or more alpha/beta hydrolases; one or more cutinases and one or more triacylglycerol lipases and one or more transcription factors regulating expression of an esterase; one or more cutinases and one or more phospholipases A2 and one or more phospholipases C; one or more cutinases and one or more phospholipases A2 and one or more acetylxylanesterases; one or more cutinases and one or more phospholipases A2 and one or more extracellular lipase-like proteins; one or more cutinases and one or more phospholipases A2 and one or more acetylesterases; one or more cutinases and one or more phospholipases A2 and one or more GDSL lipases; one or more cutinases and one or more phospholipases A2 and one or more alpha/beta hydrolases; one or more cutinases and one or more phospholipases A2 and one or more transcription factors regulating expression of an esterase; one or more cutinases and one or more phospholipases C and one or more acetylxylanesterases; one or more cutinases and one or more phospholipases C and one or more extracellular lipase-like proteins; one or more cutinases and one or more phospholipases C and one or more acetylesterases; one or more cutinases and one or more phospholipases C and one or more GDSL lipases; one or more cutinases and one or more phospholipases C and one or more alpha/beta hydrolases; one or more cutinases and one or more phospholipases C and one or more transcription factors regulating expression of an esterase; one or more cutinases and one or more acetylxylanesterases and one or more extracellular lipase-like proteins; one or more cutinases and one or more acetylxylanesterases and one or more acetylesterases; one or more cutinases and one or more acetylxylanesterases and one or more GDSL lipases; one or more cutinases and one or more acetylxylanesterases and one or more alpha/beta hydrolases; one or more cutinases and one or more acetylxylanesterases and one or more transcription factors regulating expression of an esterase; one or more cutinases and one or more extracellular lipase-like proteins and one or more acetylesterases; one or more cutinases and one or more extracellular lipase-like proteins and one or more GDSL lipases; one or more cutinases and one or more extracellular lipase-like proteins and one or more alpha/beta hydrolases; one or more cutinases and one or more extracellular lipase-like proteins and one or more transcription factors regulating expression of an esterase; one or more cutinases and one or more acetylesterases and one or more GDSL lipases; one or more cutinases and one or more acetylesterases and one or more alpha/beta hydrolases; one or more cutinases and one or more acetylesterases and one or more transcription factors regulating expression of an esterase; one or more cutinases and one or more GDSL lipases and one or more alpha/beta hydrolases; one or more cutinases and one or more GDSL lipases and one or more transcription factors regulating expression of an esterase; and one or more cutinases and one or more alpha/beta hydrolase fold domain-containing proteins and one or more transcription factors regulating expression of an esterase.

A suitable number and/or combination of esterases of which activity must be essentially eliminated or modulated in the at least one step of the method provided herein for producing a food product, or in the fermentation broth or preparation provided herein comprising a recombinant component, or in the recombinant microbial host cell provided herein capable of producing a recombinant component, can be identified by methods known in the art. For example, esterases can be isolated by methods known in the art (e.g., employing affinity chromatography, zymogram assays, gel electrophoresis) and tested in vitro to determine which one or which combination of at least two esterases provides a substantial amount of degradation of a specific diglycerides, triglyceride, phospholipid, or lipoprotein. Also, recombinant microbial host cells capable of producing a recombinant component (e.g., any recombinant component disclosed herein) can be obtained that comprise an essentially eliminated or modulated activity in any one or any combination of at least two esterases, and degree of reduction or elimination of lipid degradation of a food product comprising the recombinant component produced by each such recombinant microbial host cell can be measured by methods known in the art.

In some embodiments, the fermentation broth or preparation provided herein comprising a recombinant component, or the recombinant microbial host cell provided herein capable of producing a recombinant component, comprises a combination and/or level of esterase activities that provides a specific profile of esterase activities (i.e., esterase activity profile) that is useful for production of a specific food product. In some such embodiments, the esterase activity profile is optimized to provide a desired flavor, aroma, texture, emulsification, nutritional content, and/or shelf-life of the food product.

Esterase activity can be measured using an enzyme assay. For example, enzyme activity can be determined by pro-duction of a colorimetric reaction product or a product that can be detected (e.g., free fatty acids and/or glycerol produced from an esterase-catalyzed hydrolysis of a triglyceride), using, for example, PAGE gel, spectrophotometer, imaging, UV/Vis, light, and HPLC.

Recombinant Microbial Host Cell Producing Recombinant Component and Comprising Essentially Eliminated or Modulated Esterase Activity In another aspect, provided herein is a recombinant microbial host cell that is capable of producing a recombinant component and that comprises an essentially eliminated or modulated esterase activity (e.g., activity of any one esterase disclosed herein or activities of any combination of at least two esterases disclosed herein) compared to the esterase activity comprised in a corresponding recombinant microbial host cell.

An esterase activity comprised in a recombinant microbial host cell provided herein can be essentially eliminated or modulated by any means. In some embodiments, the esterase activity is essentially eliminated or modulated by essentially eliminating or modulating expression (i.e., production of an active protein) of the esterase, or by essentially eliminating or modulating activity of the esterase. Accordingly, in various embodiments, the recombinant microbial host cell provided herein comprises a) a genetic modification in a control sequence, or a functional part thereof (i.e., a part that is sufficient for the function of the control sequence), that drives expression of an esterase (e.g., a promoter sequence, an enhancer sequence, a signal peptide, a transcription terminator, or any other sequence that controls expression (i.e., transcription and/or translation) of a gene), wherein the genetic modification essentially eliminates or modulates expression of the esterase; b) a genetic modification in a coding sequence that encodes an esterase, or a functional part thereof (e.g., a catalytic domain), wherein the genetic modification essentially eliminates or modulates activity of the esterase; c) a genetic modification in a control sequence, or a functional part thereof (i.e., a part that is sufficient for the function of the control sequence), that drives expression of a protein required for expression of an esterase (e.g., a transcription factor, a post-translational modification enzyme required for production of an active form of an esterase), wherein the genetic modification essentially eliminates or modulates expression of the protein required for expression of the esterase and thereby essentially eliminates or modulates expression of the esterase; d) a genetic modification in a coding sequence that encodes a protein required for expression of an esterase, or a functional part thereof (e.g., a DNA binding domain of a transcription factor, a catalytic domain of a post-translational modification enzyme), wherein the genetic modification essentially eliminates or modulates activity of the protein required for expression of the esterase and thereby essentially eliminates or modulates expression of the esterase; e) a genetic modification in a control sequence, or a functional part thereof (i.e., a part that is sufficient for the function of the control sequence), that drives expression of an endogenous inhibitor of an esterase, wherein the genetic modification essentially eliminates or modulates expression of the endogenous inhibitor and thereby essentially eliminates or modulates expression of the esterase; f) a genetic modification in a coding sequence that encodes an endogenous inhibitor of an esterase, wherein the genetic modification essentially eliminates or modulates activity of the endogenous inhibitor and thereby essentially eliminates or modulates expression of the esterase; and/or g) a genetic modification that introduces a coding sequence that encodes a heterologous (i.e., non-native) inhibitor of an esterase, wherein the genetic modification provides for production of the heterologous inhibitor and thereby essentially eliminates or modulates expression of the esterase.

A genetic modification can consist of, for example, an insertion, a substitution, or a deletion of one or more nucleotides in a polynucleotide sequence. A genetic modification can, for example, introduce a stop codon; remove a start codon; insert a frame-shift of the open reading frame; or create a point mutation, missense mutation, substitution mutation, deletion mutation, frameshift mutation, insertion mutation, duplication mutation, amplification mutation, translocation mutation, or inversion mutation.

In some embodiments, the recombinant microbial host cell provided herein comprises a recombinant polynucleotide that comprises a nucleotide sequence that is complementary to a coding sequence encoding an esterase (e.g., any one esterase disclosed herein or any combination of at least two esterases disclosed herein), that encodes a RNAi construct that is specific to the esterase, or that encodes a heterologous inhibitor of the esterase activity.

In some embodiments in which the recombinant microbial host cell provided herein comprises a genetic modification that essentially eliminates or modulates expression or activity of a protein required for expression of an esterase, such protein required for expression of an esterase is a transcription factor that regulates expression of an esterase. In some such embodiments, the transcription factor that regulates expression of an esterase comprises an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from any of the sequences encoding a transcription factor regulating expression of an esterase listed in Table 1. In some such embodiments, the transcription factor that regulates expression of an esterase comprises an amino acid sequence with an amino acid sequence identity of at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, at least 99.5%, or 100% to a sequence selected from UniProt sequences G0RX49, G0RHG1, A0A2T4B416, A0A2T4BJU6, A2R2J1, A2R903, G2Q2Z5, and G2Q816. In some such embodiments, the recombinant microbial host cell provided herein comprises one or more genetic modifications that essentially eliminate or module expression or activity of a combination of at least two transcription factors that regulate expression of one or more esterases.

In some embodiments, the recombinant microbial host cell provided herein is capable of producing a recombinant component and comprises an esterase activity (e.g., activity of any one esterase disclosed herein or activities of any combination of at least two esterases disclosed herein) that is reduced by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, at least 97%, at least 98%, at least 99%, or 100% compared to the esterase activity comprised in a corresponding recombinant microbial host cell. In some such embodiments, the recombinant microbial host cell provided herein comprises an essentially eliminated esterase activity. In other embodiments, the recombinant microbial host cell provided herein is capable of producing a recombinant component and comprises an esterase activity (e.g., activity of any one esterase disclosed herein or activities of any combination of at least two esterases disclosed herein) that is increased by at least 25%, at least 50%, at least 75%, at least 100%, at least 150%, at least 200%, at least 300%, at least 400%, at least 500%, at least 600%, at least 700%, at least 800%, at least 900%, or at least 1,000% compared to the esterase activity comprised in a corresponding recombinant microbial host cell.

Microbial Host Cell

The recombinant microbial host cell provided herein can be derived from any microbial cell. In some embodiments, the recombinant microbial host cell provided herein is a recombinant bacterial host cell. The recombinant bacterial host cell can be derived from any bacterial strain known in the art. Non-limiting examples of bacterial strains include firmicutes, cyanobacteria (blue-green algae), oscillatoriophcideae, bacillales, lactobacillales, oscillatoriales, bacillaceae, lactobacillaceae, *Acetobacter* suboxydans, *Acetobacter xylinum, Actinoplane missouriensis, Arthrospira platensis, Arthrospira maxima, Bacillus cereus, Bacillus coagulans, Bacillus subtilus, Bacillus cerus, Bacillus licheniformis, Bacillus stearothermophilus, Bacillus subtilis, Escherichia coli, Lactobacillus acidophilus, Lactobacillus bulgaricus, Lactococcus lactis, Lactococcus lactis* Lancefield Group IV, *Lactobacillus reuteri, Leuconostoc citrovorum, Leuconostoc dextranicum, Leuconostoc mesenteroides* strain NRRL B-512(F), *Micrococcus* lysodeikticus, *Spirulina, Streptococcus cremoris, Streptococcus lactis, Streptococcus lactis* subspecies diacetylactis, *Streptococcus thermophilus, Streptomyces chattanoogensis, Streptomyces griseus, Streptomyces natalensis, Streptomyces olivaceus, Streptomyces olivochromogenes, Streptomyces rubiginosus, Tetrahymena thermophile, Tetrahymena hegewischi, Tetrahymena hyperangularis, Tetrahymena malaccensis, Tetrahymena pigmentosa, Tetrahymena pyriformis,* and *Tetrahymena vorax, Xanthomonas campestris*, and derivatives and crosses thereof.

In some embodiments, the recombinant microbial host cell provided herein is a recombinant yeast host cell. The recombinant yeast host cell can be derived from any yeast strain known in the art. Non-limiting examples of yeast strains include *Candida albicans, Candida etchellsii, Candida guilliermondii, Candida humilis, Candida lipolytica, Candida pseudotropicalis, Candida utilis, Candida versatilis, Debaryomyces hansenii, Eremothecium ashbyii, Hansenula polymorpha, Kluyveromyces* sp., *Kluyveromyces lactis, Kluyveromyces marxianus, Kluyveromyces thermotolerans, Pichia* sp., *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pnperi, Pichia stiptis, Pichia methanolica, Rhodotorula* sp., *Saccharomyces* sp., *Saccharomyces bayanus, Saccharomyces beticus, Saccharomyces cerevisiae, Saccharomyces chevaliers, Saccharomyces diastaticus, Saccharomyces ellipsoideus, Saccharomyces exiguus, Saccharomyces florentinus, Saccharomyces fragilis, Saccharomyces pastorianus, Saccharomyces pombe, Saccharomyces sake, Saccharomyces uvarum, Sporobolomyces roseus, Yarrowia hpolytica, Zygosaccharomyces rouxii,* and derivatives and crosses thereof.

In some embodiments, the recombinant microbial host cell provided herein is a recombinant filamentous fungal host cell. The recombinant filamentous fungal host cell can be derived from any filamentous fungus strain known in the art, including any holomorphic, teleomorphic, or anamorphic form thereof. Non-limiting examples of filamentous fungal strains include *Acremonium, Aspergillus, Aureobasidium, Canariomyces, Chaetonium, Chaetomidium, Corynascus, Cryptococcus, Chrysosporium, Coonemeria, Dactylomyces, Emericella, Filibasidium, Fusarium, Gibberella, Humicola, Lentinula, Magnaporthe, Malbranchium, Melanocarpus, Mucor, Myceliophthora, Myrothecium, Neocallimastix, Neurospora, Paecilomyces, Penicillium, Phenerochaete, Phlebia, Piromyces, Rhizopus, Schizophyllum, Scytalidium, Sporotrichum, Stereum, Talaromyces, Thermoascus, Thermomyces, Thielavia, Tolypocladium,* and *Trichoderma* strains.

Non-limiting examples of *Acremonium* strains include *Acremonium alabamense*. Non-limiting examples of *Aspergillus* strains include *Aspergillus aculeatus, Aspergillus awamori, Aspergillus clavatus, Aspergillus flavus, Aspergillus foetidus, Aspergillus fumigatus, Aspergillus japonicus, Aspergillus nidulans, Aspergillus niger, Aspergillus niger* var. *awamori, Aspergillus oryzae, Aspergillus sojae,* and *Aspergillus terreus*, as well as *Emericella, Neosartorya,* and *Petromyces* species. Non-limiting examples of *Chrysosporium* strains include *Chrysosporium botryoides, Chrysosporium carmichaeli, Chrysosporium crassitunicatum, Chrysosporium europae, Chrysosporium evolceannui, Chrysosporium farinicola, Chrysosporium fastidium, Chrysosporium filiforme, Chrysosporium georgiae, Chrysosporium globiferum, Chrysosporium globiferum* var. *articulatum, Chrysosporium globiferum* var. *niveum, Chrysosporium hirundo, Chrysosporium hispanicum, Chrysosporium holmii, Chrysosporium indicum, Chrysosporium iops, Chrysosporium keratinophilum, Chrysosporium kreiselii, Chrysosporium kuzurovianum, Chrysosporium lignorum, Chrysosporium obatum, Chrysosporium lucknowense, Chrysosporium lucknowense* Garg 27K, *Chrysosporium medium, Chrysosporium medium* var. *spissescens, Chrysosporium mephiticum, Chrysosporium merdarium, Chrysosporium merdarium* var. *roseum, Chrysosporium minor, Chrysosporium pannicola, Chrysosporium parvum, Chrysosporium parvum* var. *crescens, Chrysosporium pilosum, Chrysosporium pseudomerdarium, Chrysosporium pyriformis, Chrysosporium queenslandicum, Chrysosporium sigleri, Chrysosporium sulfureum, Chrysosporium synchronum, Chrysosporium tropicum, Chrysosporium undulatum, Chrysosporium vallenarense, Chrysosporium vespertilium,* and *Chrysosporium zonatum*.

Non-limiting examples of *Fusarium* strains include *Fusarium moniliforme, Fusarium venenatum, Fusarium oxysporum, Fusarium graminearum, Fusarium proliferatum, Fusarium verticiollioides, Fusarium culmorum, Fusarium crookwellense, Fusarium poae, Fusarium sporotrichioides, Fusarium sambuccinum,* and *Fusarium torulosum*, as well as associated *Gibberella* teleomorphic forms thereof. Non-limiting examples of *Myceliophthora* strains include *Myceliophthora thermophila*. Non-limiting examples of *Mucor* strains include *Mucor miehei* Cooney et Emerson (*Rhizomucor miehei* (Cooney & R. Emerson))

Schipper, and *Mucor pusillus* Lindt. Non-limiting examples of *Neurospora* strains include *Neurospora crassa*.

Non-limiting examples of *Penicillium* strains include *Penicillium chrysogenum* and *Penicillium roquefortii*. Non-limiting examples of *Rhizopus* strains include *Rhizopus niveus*. Non-limiting examples of *Sporotrichum* strains include *Sporotrichum cellulophilum*. Non-limiting examples of *Thielavia* strains include *Thielavia terrestris*. Non-limiting examples of *Trichoderma* strains include *Trichoderma harzianum, Trichoderma koningii, Trichoderma longibrachiatum, Trichoderma reesei, Trichoderma atroviride, Trichoderma vixens, Trichoderma citrinoviride*, and *Trichoderma viride*, as well as alternative sexual/teleomorphic forms thereof (i.e., *Hypocrea* species).

The recombinant microbial host cell provided herein can be sporulation-competent or sporulation-deficient.

The recombinant microbial host cell provided herein can be derived from a wild-type microbial cell or from a genetic variant (e.g., mutant) thereof.

The recombinant microbial host cell provided herein can be derived from a generally recognized as safe (GRAS) industrial stain.

The recombinant microbial host cell provided herein can have a high exogenous secreted protein/biomass ratio. In some such embodiments, the ratio is greater than about 1:1, greater than about 2:1, greater than about 3:1, greater than about 4:1, greater than about 5:1, greater than about 6:1, greater than about 7:1, or greater than about 8:1.

In some embodiments, a recombinant microbial host cell provided herein comprising an essentially eliminated or modulated activity of an esterase or of a combination of at least two (e.g., at least 2, at least 3, at least 4, at least 5, at least 6, at least 7, at least 8, at least 9, at least 10, at least 11, at least 12, or more) esterases is selected from the group consisting of a recombinant *Trichoderma reesei* host cell (i.e., a recombinant host cell derived from a *Trichoderma reesei* strain) comprising an essentially eliminated or modulated activity of an esterase or of a combination of at least two (e.g., at least 2, at least 3, at least 4, at least 5, at least 6, at least 7, at least 8, at least 9, at least 10, at least 11, at least 12, or more) esterases, a recombinant *Aspergillus niger* host cell (i.e., a recombinant host cell derived from a *Aspergillus niger* strain) comprising an essentially eliminated or modulated activity of an esterase or of a combination of at least two (e.g., at least 2, at least 3, at least 4, at least 5, at least 6, at least 7, at least 8, at least 9, at least 10, at least 11, at least 12, or more) esterases, a recombinant *Trichoderma citrinoviride* host cell (i.e., a recombinant host cell derived from a *Trichoderma citrinoviride* strain) comprising an essentially eliminated or modulated activity of an esterase or of a combination of at least two (e.g., at least 2, at least 3, at least 4, at least 5, at least 6, at least 7, at least 8, at least 9, at least 10, at least 11, at least 12, or more) esterases, and a recombinant *Myceliophthora thermophila* host cell (i.e., a recombinant host cell derived from a *Myceliophthora thermophila* strain) comprising an essentially eliminated or modulated activity of an esterase or of a combination of at least two (e.g., at least 2, at least 3, at least 4, at least 5, at least 6, at least 7, at least 8, at least 9, at least 10, at least 11, at least 12, or more) esterases.

Recombinant Component

The recombinant microbial host cell provided herein is capable of producing a recombinant component. Non-limiting examples of recombinant components include proteins, lipids, carbohydrates, small molecules, food additives, food supplements (e.g., vitamins), neutraceuticals, and probiotics.

In some embodiments, the recombinant component is a recombinant protein. In some embodiments, the recombinant protein is a recombinant plant protein. The term "plant protein" as used herein refers to a polypeptide that comprises a sequence of at least 20 amino acids (e.g., at least 20, at least 30, at least 40, at least 50, at least 60, at least 70, at least 80, at least 90, at least 100, or at least 150, and usually not more than 250 amino acids) that is at least 80% identical (e.g., at least 80% identical, at least 85% identical, at least 90% identical, at least 95% identical, at least 99% identical, 100% identical) to a sequence of amino acids in a protein natively found in a plant (i.e., a protein that is native to a plant cell). Non-limiting examples of plant proteins include proteins derived from cycads, *Ginkgo biloba*, conifers, cypress, junipers, *thuja*, cedarwood, pines, *angelica*, caraway, coriander, cumin, fennel, parsley, dill, dandelion, helichrysum, marigold, mugwort, safflower, camomile, lettuce, wormwood, calendula, citronella, sages, thyme, chia seed, mustard, olive, coffee, *capsicum*, eggplant, paprika, cranberry, kiwi, vegetable plants (e.g., carrot, celery), *tagetes*, tansy, tarragon, sunflower, wintergreen, basil, hyssop, lavender, lemon *verbena*, marjoram, melissa, patchouli, pennyroyal, peppermint, rosemary, sesame, spearmint, primroses, samara, pepper, pimento, potato, sweet potato, tomato, blueberry, nightshades, *petunia*, morning glory, lilac, jasmin, honeysuckle, snapdragon, *psyllium*, wormseed, buckwheat, amaranth, chard, *quinoa*, spinach, rhubarb, jojoba, cypselea, *chlorella*, marula, hazelnut, canola, kale, bok choy, rutabaga, frankincense, myrrh, elemi, hemp, pumpkin, squash, curcurbit, manioc, *dalbergia*, legume plants (e.g., alfalfa, lentils, beans, clovers, peas, fava coceira, frijole bola roja, frijole negro, *lespedeza*, licorice, lupin, mesquite, carob, soybean, peanut, tamarind, *wisteria, cassia*, chickpea/garbanzo, fenugreek, green pea, yellow pea, snow pea, lima bean, fava bean), geranium, flax, pomegranate, cotton, okra, neem, fig, mulberry, clove, *eucalyptus*, tea tree, niaouli, fruiting plants (e.g., apple, apricot, peach, plum, pear, nectarine), strawberry, blackberry, raspberry, cherry, prune, rose, tangerine, citrus (e.g., grapefruit, lemon, lime, orange, bitter orange, mandarin, tangerine), mango, citrus bergamot, buchu, grape, broccoli, brussels sprout, camelina, cauliflower, rape, rapeseed (canola), turnip, cabbage, cucumber, watermelon, honeydew melon, zucchini, birch, walnut, cassava, baobab, allspice, almond, breadfruit, sandalwood, macadamia, taro, tuberose, aloe vera, garlic, onion, shallot, vanilla, *yucca*, vetiver, galangal, barley, corn, *curcuma aromatica*, ginger, lemon grass, oat, palm, pineapple, rice, rye, sorghum, triticale, turmeric, yam, bamboo, barley, cajuput, *canna*, cardamom, maize, oat, wheat, cinnamon, *sassafras, lindera benzoin*, bay laurel, avocado, ylang-ylang, mace, nutmeg, moringa, horsetail, oregano, cilantro, chervil, chive, aggregate fruits, grain plants, herbal plants, leafy vegetables, non-grain legume plants, nut plants, succulent plants, land plants, water plants, delbergia, millets, drupes, schizocarps, flowering plants, non-flowering plants, cultured plants, wild plants, trees, shrubs, flowers, grasses, herbaceous plants, brushes, lianas, cacti, tropical plants, subtropical plants, temperate plants, and derivatives and crosses thereof.

In some embodiments, the plant protein is a pea protein (e.g., legumin, vicillin, covicillin). In other embodiments, the plant protein is a potato protein (e.g., tuberin, protease inhibitor notate II).

In some embodiments, the recombinant protein is a recombinant animal protein. The term "animal protein" as used herein refers to a polypeptide that comprises a sequence of at least 20 amino acids (e.g., at least 20, at least 30, at least 40, at least 50, at least 60, at least 70, at least 80, at least 90, at least 100, or at least 150, and usually not more than 250 amino acids) that is at least 80% identical (e.g., at least 80% identical, at least 85% identical, at least 90% identical, at least 95% identical, at least 99% identical, 100% identical) to a sequence of amino acids in a protein natively found in an animal (i.e., a protein that is native to an animal cell). Non-limiting examples of animal proteins include proteins derived from insects (e.g., fly), mammals (e.g., cow, sheep, goat, rabbit, pig, human), or birds (e.g., chicken). In some embodiments, the animal protein is a structural protein (e.g., collagen, tropoelastin, elastin). In other embodiments, the animal protein is an egg protein (e.g., ovalbumin).

In yet other embodiments, the recombinant protein is a recombinant milk protein. The term "milk protein" as used herein refers to a polypeptide that comprises a sequence of at least 20 amino acids (e.g., at least 20, at least 30, at least 40, at least 50, at least 60, at least 70, at least 80, at least 90, at least 100, or at least 150, and usually not more than 250 amino acids) that is at least 80% identical (e.g., at least 80% identical, at least 85% identical, at least 90% identical, at least 95% identical, at least 99% identical, 100% identical) to a sequence of amino acids in a protein natively found in a mammal-produced milk (i.e., a protein that is native to mammal-produced milk).

The recombinant milk protein can be a recombinant whey protein or a recombinant casein. The term "whey protein" or "casein" as used herein refers to a polypeptide that comprises a sequence of at least 20 amino acids (e.g., at least 20, at least 30, at least 40, at least 50, at least 60, at least 70, at least 80, at least 90, at least 100, or at least 150, and usually not more than 250 amino acids) that is at least 80% identical (e.g., at least 80% identical, at least 85% identical, at least 90% identical, at least 95% identical, at least 99% identical, 100% identical) to a sequence of amino acids in a native whey protein or casein, respectively. Non-limiting examples of whey proteins include α-lactalbumin, β-lactoglobulin, lactoferrin, transferrin, serum albumin, lactoperoxidase, and glycomacropeptide. Non-limiting examples of caseins include β-casein, γ-casein, κ-casein, α-S1-casein, and α-S2-casein. Non-limiting examples of nucleic acid sequences encoding whey proteins and caseins are disclosed in PCT filing PCT/US2015/046428 filed Aug. 21, 2015, and PCT filing PCT/US2017/48730 filed Aug. 25, 2017, which are hereby incorporated herein in their entireties.

The recombinant milk protein can be derived from any mammalian species, including but not limited to cow, human, sheep, goat, buffalo, camel, horse, donkey, lemur, panda, guinea pig, squirrel, bear, macaque, gorilla, chimpanzee, mountain goat, monkey, ape, cat, dog, wallaby, rat, mouse, elephant, opossum, rabbit, whale, baboons, gibbons, orangutan, mandrill, pig, wolf, fox, lion, tiger, and echidna.

The recombinant milk protein can lack epitopes that can elicit immune responses in a human or animal. Such recombinant milk proteins are particularly suitable for use in food products.

The recombinant milk protein can have a post-translational modification. The term "post-translational modification", or its acronym "PTM", as used herein refers to the covalent attachment of a chemical group to a protein after protein biosynthesis. PTM can occur on the amino acid side chain of the protein or at its C- or N-termini. Non-limiting examples of PTMs include glycosylation (i.e., covalent attachment to proteins of glycan groups (i.e., monosaccharides, disaccharides, polysaccharides, linear glycans, branched glycans, glycans with galf residues, glycans with sulfate and/or phosphate residues, D-glucose, D-galactose, D-mannose, L-fucose, N-acetyl-D-galactose amine, N-acetyl-D-glucose amine, N-acetyl-D-neuraminic acid, galactofuranose, phosphodiesters, N-acetylglucosamine, N-acetylgalactosamine, sialic acid, and combinations thereof; see, for example, Deshpande et al. 2008. Glycobiology 18(8):626) via C-linkage, N-linkage, or O-linkage, or via glypiation (i.e., addition of a glycosylphosphatidylinositol anchor) or phosphoglycosylation (i.e., linked through the phosphate of a phospho-serine)), phosphorylation (i.e., covalent attachment to proteins of phosphate groups), alkylation (i.e., covalent attachment to proteins of alkane groups (e.g, methane group in methylation)), and lipidation (i.e., covalent attachment of a lipid group (e.g., isoprenoid group in prenylation and isoprenylation (e.g., farnesol group in farnesylation, geraniol group in geranylation, geranylgeraniol group in geranylgeranylation), fatty acid group in fatty acylation (e.g., myristic acid in myristoylation, palmitic acid in palmitoylation), glycosylphosphatidylinositol anchor in glypiation)), hydroxylation (i.e., covalent attachment of a hydroxide group), sumoylation (i.e., attachment to proteins of Small Ubiquitin-like Modifier (or SUMO) protein), nitrosylation (i.e., attachment to proteins of an NO group), and tyrosine nitration (i.e., attachment to tyrosine residues of proteins of nitrate groups). The PTM of the recombinant milk protein can be a native PTM, a non-native PTM, or a mixture of at least one native PTM and at least one non-native PTM. The term "non-native PTM" as used herein refers to a difference in one or more location(s) of one or more PTMs (e.g., glycosylation, phosphorylation) in a protein, and/or a difference in the type of one or more PTMs at one or more location(s) in a protein compared to the native protein (i.e., the protein having "native PTMs").

The recombinant milk protein can have a milk protein repeat. The term "milk protein repeat" as used herein refers to an amino acid sequence that is at least 80% identical (e.g., at least 85%, at least 90%, at least 95% identical, at least 99% identical) to an amino acid sequence in a protein found in a mammal-produced milk (e.g., a whey protein, a casein) and that is present more than once (e.g., at least 2, at least 3, at least 4, at least 5, at least 10, at least 15, at least 20, at least 30, at least 40, at least 50, at least 75, at least 100, at least 150, or at least 200 times) in the recombinant milk protein. A milk protein repeat may comprise at least 10, at least 20, at least 30, at least 40, at least 50, at least 75, at least 100, or at least 150, and usually not more than 200 amino acids. A milk protein repeat in a recombinant milk protein can be consecutive (i.e., have no intervening amino acid sequences) or non-consecutive (i.e., have intervening amino acid sequences). When present non-consecutively, the intervening amino acid sequence may play a passive role in providing molecular weight without introducing undesirable properties, or may play an active role in providing for particular properties (e.g., solubility, biodegradability, binding to other molecules).

In some embodiments, the recombinant protein is a recombinant algae protein. The term "algae protein" as used herein refers to a polypeptide that comprises a sequence of at least 20 amino acids (e.g., at least 20, at least 30, at least 40, at least 50, at least 60, at least 70, at least 80, at least 90, at least 100, or at least 150, and usually not more than 250 amino acids) that is at least 80% identical (e.g., at least 80% identical, at least 85% identical, at least 90% identical, at least 95% identical, at least 99% identical, 100% identical) to a sequence of amino acids in a protein natively found in an algae (i.e., a protein that is native to an algal cell).

In some embodiments, the recombinant protein is a recombinant fungal protein. The term "fungal protein" as used herein refers to a polypeptide that comprises a sequence of at least 20 amino acids (e.g., at least 20, at least 30, at least 40, at least 50, at least 60, at least 70, at least 80, at least 90, at least 100, or at least 150, and usually not more than 250 amino acids) that is at least 80% identical (e.g., at least 80% identical, at least 85% identical, at least 90% identical, at least 95% identical, at least 99% identical, 100% identical) to a sequence of amino acids in a protein natively found in a fungus (i.e., a protein that is native to a fungal cell).

In some embodiments, the recombinant protein is a recombinant microbial protein. The term "microbial protein" as used herein refers to a polypeptide that comprises a sequence of at least 20 amino acids (e.g., at least 20, at least 30, at least 40, at least 50, at least 60, at least 70, at least 80, at least 90, at least 100, or at least 150, and usually not more than 250 amino acids) that is at least 80% identical (e.g., at least 80% identical, at least 85% identical, at least 90% identical, at least 95% identical, at least 99% identical, 100% identical) to a sequence of amino acids in a protein natively found in a microbe (i.e., a protein that is native to a microbial cell).

General Methods

A recombinant microbial host cell that is capable of producing a recombinant component can be obtained using methods known in the art. The recombinant microbial host cell typically comprises a recombinant polynucleotide (e.g., a recombinant vector) encoding the recombinant component. The recombinant polynucleotide can be prepared by any suitable method known in the art, including, without limitation, direct chemical synthesis and cloning.

The recombinant polynucleotide typically comprises one or more expression cassettes, wherein each expression cassette comprises: a promoter (e.g., a fungal promoter), an optional signal sequence (i.e., a sequence that encodes a peptide that mediates the delivery of a nascent protein attached to the peptide to the exterior of the cell in which the nascent protein is synthesized), a sequence encoding a recombinant protein, and a termination sequence (or multiple termination sequences), wherein the promoter is operably linked in sense orientation to the optional signal sequence (i.e., the promoter and optional signal sequence and subsequent sequence encoding the protein are positioned such that the promoter is effective for regulating transcription of the optional signal sequence and sequence encoding the protein), the optional signal sequence is operably linked in sense orientation to the sequence encoding a recombinant protein (i.e., the signal sequence and sequence encoding a recombinant protein are positioned such that transcription and translation produces a recombinant protein comprising a functional signal sequence), and the termination sequence is operably linked to the sequence encoding a recombinant protein (i.e., the sequence encoding a recombinant protein and the termination sequence are positioned such that the terminator is effective for terminating transcription of the optional signal sequence and sequence encoding a recombinant protein).

The promoter may be any suitable promoter that is functional in the recombinant microbial host cell. In some embodiments, the promoter is a constitutive promoter. In other embodiments, the promoter is an inducible promoter or a repressible promoter (e.g., a promoter that is induced or repressed in the presence of glucose, galactose, lactose, sucrose, cellulose, sophorose, gentiobiose, sorbose, disaccharides that induce the cellulase promoters, starch, tryptophan, or phosphate). Non-limiting examples of suitable promoters for use in recombinant filamentous fungal host cells include promoters, and functional parts thereof, of genes encoding any of the following proteins: glucoamylase (e.g., glaA of *Aspergillus niger*, *Aspergillus awamori*, *Aspergillus japonicus*, *Aspergillus tubingensis*, *Aspergillus foetidus*, or *Aspegillus carbonarius*), amylase (e.g., *Aspergillus oryzae* TAKA amylase, *Aspergillus niger* neutral alpha-amylase, *Aspergillus niger* acid stable alpha-amylase, fungal α-amylase (amy), bacterial alpha-amylase), protease (e.g., *Rhizomucor miehei* aspartic protease, *Aspergillus oryzae* alkaline protease, *Fusarium oxysporum* trypsin-like protease, *Trichoderma reesei* protease), lipase (e.g., *Rhizomucor miehei* lipase), isomerase (e.g., *Aspergillus oryzae* triose phosphate isomerase, fungal triose phosphate isomerase (tpi), yeast triosephosphate isomerase), acetamidase (e.g., *Aspergillus nidulans* or *Aspergillus oryzae* or other fungal acetamidase (amdS)), dehydrogenase (e.g., fungal alcohol dehydrogenase (adhA), fungal glyceraldehyde-3-phosphate dehydrogenase (gpd), yeast alcohol dehydrogenase), xylanase (e.g., fungal xylanase (xlnA), *Trichoderma* xylanases (xyn1, xyn2, bxl1)), kinase (e.g., yeast 3-phosphoglycerate kinase), hydrolase (e.g., fungal cellobiohydrolase I (cbh1), *Trichoderma* hydrolases (cbh2, egl1, egl2)), phosphatase (e.g., *Fusarium* acid phosphatase), and other fungal proteins (e.g., fungal endo α-L-arabinase (abnA), fungal α-L-arabinofuranosidase A (abfA), fungal α-L-arabinofuranosidase B (abfB), fungal phytase, fungal ATP-synthetase, fungal subunit 9 (oliC), fungal sporulation-specific protein (Spo2), fungal SSO, yeast alcohol oxidase, yeast lactase, *Neurospora crassa* CPC1, *Aspergillus nidulans* trpC, fungal chitinolytic enzymes (e.g., endo- & exo-chitinase, beta-glucanase), fungal VAMP-associated proteins (VAPs), fungal translation elongation factor (TEF1) fungal DNA damage-responsive protein (DDRP), fungal (e.g., *Fusarium* or *Neurospora crassa*) hexagonal peroxisome (Hex1), fungal (e.g., *Neurospora crassa*) catalase), and any other protein produced at high level in the recombinant filamentous fungal host cell.

Non-limiting examples of suitable promoters for use in recombinant bacterial or yeast host cells include promoters, and functional parts thereof, of genes encoding any of the following proteins: LAC4, T7 polymerase, TAC, GAL1, λPL, λPR, beta-lactamase, spa, CYC1, TDH3, GPD, TEF1, ENO2, PGL1, GAP, SUC2, ADH1, ADH2, HXT7, PHO5, CLB1, AOX1, cellulase, amylase, protease, xylanase, and any other protein produced at high level in the recombinant filamentous fungal host cell.

In some embodiments, the promoters are promoters of stress (e.g., heat shock) response genes (e.g., hac1, BIP).

The signal sequence may be any suitable signal sequence that is functional in the recombinant microbial host cell.

The recombinant protein that is typically encoded by the recombinant polynucleotide can be any recombinant protein (e.g., a recombinant component disclosed herein), including a recombinant milk protein (e.g., any of the recombinant milk proteins disclosed herein (e.g., recombinant b-lactoglobulin, recombinant α-lactalbumin, recombinant k-casein, recombinant b-casein), recombinant egg protein (e.g., ovotransferrin (conalbumin), ovomucin, ovalbumin, ovotransferrin, lysozyme), recombinant proteins required for production of vitamins, recombinant proteins required for production of lipids, small moecules that create flavor, polymers that create textures and emulsion, and combinations thereof.

The termination sequence may be any suitable termination sequence that is functional in the recombinant microbial host cell. Non-limiting examples of suitable termination sequences for use in recombinant filamentous fungal host cells include but are not limited to termination sequences of *Aspergillus oryzae* (e.g., termination sequence of TAKA amylase gene), *Aspergillus niger* (e.g., termination sequence of glaA, gpdA, aamA, trpC, pdc1, adh1, amdS, or tef1 gene), *Fusarium oxysporum* (e.g., termination sequence of serine protease (trypsin) gene), *Trichoderma reesei* (e.g., termination sequence of cbh1, pdc1, TEF1, gpd1, xyn1, or adh1 gene), *Pichia pastoris* (e.g., termination sequence of aox1, gap1, adh1, tef1, tps1, or pgk1 gene), *Saccharomyces cerevisiae* (e.g., termination sequence of adh1, cyc1, gal1, tef1, pdc1, pgk1, or tps1 gene), synthetic termination sequences, and any combination of the above listed sequences. Non-limiting examples of suitable termination sequences for use in recombinant yeast host cells include but are not limited to the PGK1 and TPS1 termination sequences.

The recombinant polynucleotide can further include additional elements. Non-limiting examples of such additional elements include enhancer sequences, response elements, protein recognition sites, inducible elements, protein binding sequences, 5' and 3' untranslated regions, polyadenylation sequences, introns, origins of replication, operators (i.e., sequences of nucleic acids adjacent to a promoter that comprise a protein-binding domain where a repressor protein can bind and reduce or eliminate activity of the promoter), and selection markers (i.e., genes that encode proteins that can complement the filamentous fungal cell's auxotrophy, provide antibiotic resistance, or result in a color change). Such elements are known in the art. Non-limiting examples of origins of replication include AMA1 and ANSI. Non-limiting examples of suitable selection markers include amdS (acetamidase), argB (ornithine carbamoyltransferase), bar (phosphinothricin acetyltransferase), hph (hygromycin phosphotransferase), niaD (nitrate reductase), pyrG/pyr4 (orotidine 5'-phosphate decarboxylase), sC (sulfate adenyltransferase), and trpC (anthranilate synthase), and derivatives thereof. In some embodiments, the selection marker comprises an alteration that decreases production of the selective marker, thus increasing the number of copies needed to permit a filamentous fungal cell comprising the polynucleotide to survive under selection.

In embodiments in which the recombinant polynucleotide comprises two or more expression cassettes, the operably linked promoters, optional signal sequences, sequences encoding a polypeptide termination sequences, and optional additional elements can be identical or different between the two or more expression cassettes.

Methods for introducing a recombinant polynucleotide into a microbial cell to obtain a recombinant microbial host cell are well-known in the art. Non-limiting examples of such methods include calcium phosphate transfection, dendrimer transfection, liposome transfection (e.g., cationic liposome transfection), cationic polymer transfection, cell squeezing, sonoporation, optical transfection, protoplast fusion, impalefection, hyrodynamic delivery, gene gun, magnetofection, viral transduction, electroporation and chemical transformation (e.g., using PEG).

In some embodiments, the recombinant polynucleotide is maintained extra-chromosomal in the recombinant microbial host cell on expression vectors (i.e., a nucleic acid that transduces, transforms, or infects a host cell, and causes it to express nucleic acids and/or proteins other than those native to the host cell, or in a manner not native to the host cell). In other embodiments, the recombinant polynucleotide is stably integrated within the genome (e.g., a chromosome) of the recombinant microbial host cell. For integration into the genome, the recombinant polynucleotide can comprise sequences for integration into the genome by homologous or nonhomologous recombination. In some embodiments, such sequences enable integration into the host genome at a precise location. The recombinant polynucleotide may comprise at least 100, at least 250, at least 500, at least 750, at least 1,000, or at least 10,000 base pairs that are highly homologous with a target sequence in the genome of the recombinant microbial host cell to enhance the probability of homologous recombination. Such highly homologous sequence may be non-coding or coding. More than one copy of the recombinant polynucleotide may be inserted into the recombinant microbial host cell to increase production of the recombinant protein.

A recombinant microbial host cell can be cultured in any suitable fermentation vessel known in the art (e.g., culture plate, shake flask, fermentor (e.g., stirred tank fermentor, airlift fermentor, bubble column fermentor, fixed bed bioreactor, laboratory fermentor, industrial fermentor, or any combination thereof)) and at any scale (e.g, small-scale, large-scale) and process (e.g., continuous, batch, fed-batch, or solid state) known in the art.

Suitable culture media include any culture medium in which the recombinant microbial host cell can grow and/or remain viable. In some embodiments, the culture medium is an aqueous medium that comprises a carbon, a nitrogen (e.g., anhydrous ammonia, ammonium sulfate, ammonium nitrate, diammonium phosphate, monoammonium phosphate, ammonium polyphosphate, sodium nitrate, urea, peptone, protein hydrolysates, yeast extract), and a phosphate source. The culture medium can further comprise an inorganic salt, a mineral, a metal, a transition metal, a vitamin, an emulsifying oil, a surfactant, and any other nutrient. Non-limiting examples of suitable carbon sources include monosaccharides, disaccharides, polysaccharides, acetate, ethanol, methanol, glycerol, methane, and combinations thereof. Non-limiting examples of monosaccharides include dextrose (glucose), fructose, galactose, xylose, arabinose, and combinations thereof. Non-limiting examples of disaccharides include sucrose, lactose, maltose, trehalose, cellobiose, and combinations thereof. Non-limiting examples of polysaccharides include starch, glycogen, cellulose, amylose, hemicellulose, maltodextrin, and combinations thereof. Suitable culture media are available from commercial suppliers or may be prepared according to published compositions (e.g., in catalogues of the American Type Culture Collection).

Suitable conditions for production of the recombinant component are those under which the recombinant microbial host cell can grow and/or remain viable. Non-limiting examples of such conditions include a suitable pH, a suitable temperature, a suitable feed rate, a suitable pressure, a suitable nutrient content (e.g., a suitable carbon content, a suitable nitrogen content, a suitable phosphorus content), a suitable supplement content, a suitable trace metal content, and a suitable level of oxygenation.

In some embodiments, the culture medium further comprises a protease (e.g., a plant-based protease) that can prevent degradation of a recombinant protein, a protease inhibitor that reduces the activity of a protease that can degrade the recombinant protein, and/or a sacrificial protein that can siphon away protease activity. In some embodiments, the culture medium further comprises a non-natural amino acid for incorporation in the recombinant protein produced.

Other Genetic Modifications

The recombinant microbial host cell provided herein can further comprise a genetic modification that improves production of the recombinant component. Non-limiting examples of such genetic modifications include altered promoters, altered kinase activities, altered phosphatase activities, altered protein folding activities, altered protein secretion activities, and altered gene expression induction pathways.

The recombinant microbial host cell provided herein can further have reduced or essentially eliminated activity of a protease so as to minimize degradation of the recombinant protein (see, for example, PCT application WO 96/29391). Filamentous fungal cells with reduced or essentially eliminated activity of a protease can be obtained by screening of mutants or by specific genetic modification as per methods known in the art.

The recombinant microbial host cell provided herein can further comprise a native or heterologous glycosyltransferase. Non-limiting examples of such endogenous or heterologous glycosyltransferases include fucosyltransferases, galactosyltransferases, glucosyltransferases, xylosyltransferases, acetylases, glucoronyltransferases, glucoronylepimerases, sialyltransferases, mannosyltransferases, sulfotransferases, β-acetylgalactosaminyltransferases, and N-acetylglucosaminyltransferases.

The recombinant microbial host cell provided herein can further comprise a native or heterologous kinase or phosphatase. Non-limiting examples of such native or heterologous kinases or phosphatases include protein kinase A, protein kinase B, protein kinase C, creatine kinase B, protein kinase C beta, protein kinase G, TmkA, Fam20 kinases (e.g., Fam20C), ATM, CaM-II, cdc2, cdk5, CK1, CMI, DNAPK, EGFR, GSK3, INSR, p38MAPK, RSK, SRC, phosphotransferases, alkaline phosphatase (e.g., UniProtKB—O77578), acid phosphatase, and others (see, for example, Kabir & Kazi. 2011. Genet Mol Biol. 34(4):587).

Preparation Comprising Recombinant Component and Essentially Eliminated or Modulated Esterase Activity In another aspect, provided herein is a preparation that comprises a recombinant component (e.g., any of the recombinant components disclosed herein) and an esterase activity (e.g., activity of any one esterase disclosed herein or activities of any combination of at least two esterases disclosed herein) that is essentially eliminated or modulated compared to the esterase activity comprised in a corresponding preparation.

In some embodiments, the preparation provided herein comprises a recombinant component and an essentially eliminated or modulated esterase activity that is reduced by at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, at least 97%, at least 98%, at least 99%, or 100% compared to the esterase activity comprised in a corresponding preparation. In some such embodiments, the preparation provided herein comprises a recombinant component and an essentially eliminated esterase activity. In other embodiments, the preparation provided herein comprises a recombinant component and an esterase activity that is increased by at least 25%, at least 50%, at least 75%, at least 100%, at least 150%, at least 200%, at least 300%, at least 400%, at least 500%, at least 600%, at least 700%, at least 800%, at least 900%, or at least 1,000% compared to the esterase activity comprised in a corresponding preparation.

The preparation provided herein can be obtained by purifying a recombinant component produced by a recombinant microbial host cell provided herein from a fermentation broth comprising the recombinant microbial host cell.

Methods for purifying a recombinant component from a fermentation broth are well-known in the art (see, for example, Protein Purification, J C Janson and L Ryden, Eds., VCH Publishers, New York, 1989; Protein Purification Methods: A Practical Approach, ELV Harris and S Angel, Eds., IRL Press, Oxford, England, 1989).

A recombinant component can be purified on the basis of its molecular weight, by, for example, size exclusion/exchange chromatography, ultrafiltration through membranes, gel permeation chromatography (e.g., preparative disc-gel electrophoresis), or density centrifugation.

A recombinant component also can be purified on the basis of its surface charge or hydrophobicity/hydrophilicity, by, for example, isoelectric precipitation, anion/cation exchange chromatography, isoelectric focusing (IEF), or reverse phase chromatography.

A recombinant component also can be purified on the basis of its solubility, by, for example, ammonium sulfate precipitation, isoelectric precipitation, surfactants, detergents, or solvent extraction.

A recombinant component also can be purified on the basis of its affinity to another molecule, by, for example, affinity chromatography, reactive dyes, or hydroxyapatite. Affinity chromatography can include the use of an antibody having a specific binding affinity for the recombinant component, or nickel NTA for a His-tagged recombinant protein, or a lectin to bind to a sugar moiety on a recombinant protein, or any other molecule that specifically binds the recombinant component. In some embodiments, the recombinant component carries a tag that facilitates purification. Non-limiting examples of such tags include epitope tags and protein tags. Non-limiting examples of epitope tags include c-myc, hemagglutinin (HA), polyhistidine (6×-HIS), GLU-GLU, and DYKDDDDK (FLAG) epitope tags. Non-limiting examples of protein tags include glutathione-S-transferase (GST), green fluorescent protein (GFP), and maltose binding protein (MBP). An epitope or protein tag may be removed following isolation of the recombinant component (e.g., via protease cleavage).

In embodiments in which the recombinant component is secreted by the recombinant microbial host cell, the recombinant component can be purified directly from the fermentation broth. In other embodiments, the recombinant component can be purified from a cell lysate.

The identity of the recombinant component can be confirmed and/or quantified by high performance liquid chromatography (HPLC), Western blot analysis, Eastern blot analysis, polyacrylamide gel electrophoresis, capillary electrophoresis, formation of an enzyme product, disappearance of an enzyme substrate, and 2-dimensional mass spectroscopy (2D-MS/MS) sequence identification.

In some embodiments, the recombinant component is purified to a purity of greater than 30%, greater than 35%, greater than 40%, greater than 45%, greater than 50%, greater than 55%, greater than 60%, greater than 65%, greater than 70%, greater than 75%, greater than 80%, greater than 85%, greater than 90%, greater than 95%, greater than 97%, or greater than 99% relative to other components comprised in the fermentation broth. In some embodiments, the recombinant component is purified to be at least two-fold, at least 3-fold, at least 4-fold, at least 5-fold, at least 6-fold, at least 7-fold, at least 8-fold, at least 9-fold, or at least 10-fold more abundant relative to other components in the preparation than it was in the fermentation broth. In some embodiments, the recombinant component is purified to a purity of greater than 30%, greater than 35%, greater than 40%, greater than 45%, greater than 50%, greater than 55%, greater than 60%, greater than 65%, greater than 70%, greater than 75%, greater than 80%, greater than 85%, greater than 90%, greater than 95%, greater than 97%, or greater than 99% by weight.

In some embodiments, the preparation is a liquid. In other embodiments, the preparation is a solid. In some such embodiments, the preparation is a powder. In some such embodiments, the powder comprises a moisture content of less than 10%, less than 7%, less than 5%, less than 3%, or less than 1% by weight. A powder can be obtained, for example, by spray drying or concentrating via evaporation.

In some embodiments, the preparation comprises a recombinant component that is post-processed. Post-processing of a recombinant component can comprise fragmenting (e.g., by chemical means or by exposure to protease enzymes (e.g., trypsin, pepsin, calmapepsin)), removing reactive sites (e.g., removing reactive sites of methionine and/or tryptophan residues by oxidation), modulating (e.g., via chemical, photochemical, and/or enzymatic strategies), cyclizing, biotinylating (i.e., attaching biotin), and conjugation to other elements (e.g., poly-ethylene-glycol, antibodies, liposomes, phospholipids, DNA, RNA, nucleic acids, sugars, disaccharides, polysacharides, starches, cellulose, detergents, cell walls).

Post-processing can occur in a random manner or in a site-specific manner (e.g., at sufhydryl groups of cystein residues (e.g., for aminoethylation, formation of iodoacetamides, formation of maleimides, formation of Dha, covalent attachment via disulfide bonds, and desulfurization); primary amine groups of lysine residues (e.g., for attachment of activated esters, sulfonyl chlorides, isothiocyanates, unsaturated aldehyde esters, and aldehydes); phenolic hydroxyl groups of tyrosine residues; removal of specific epitopes (e.g., glycan groups) that can elicit immune responses in humans; azo-electrocyclization).

Post-processing may alter certain chemical and/or physical properties of the recombinant component, including but not limited to size, charge, hydrophobicity, hydrophilicity, solvation, protein folding, and chemical reactivity.

Food Product Comprising Recombinant Component

In another aspect, provided herein is a food product that comprises a recombinant component (e.g., any of the recombinant components disclosed herein) produced by a recombinant microbial host cell provided herein, and that comprises an essentially eliminated or modulated esterase activity (e.g., activity of any one esterase disclosed herein or activities of any combination of at least two esterases disclosed herein) compared to the esterase activity in a corresponding food product. The term "food product" as used herein refers to a product that can be ingested by a human or an animal, including a domesticated animal (e.g., dog, cat), farm animal (e.g., cow, pig, horse), and wild animal (e.g., non-domesticated predatory animal). The term includes products that can be combined with or added to one or more other ingredients to make a food product that can be ingested by a human or an animal. In various embodiments, the food product provided herein meets standards for food safety required by the U.S. Food and Drug Administration (FDA), the U.S. Department of Agriculture, the European Food Safety Authority, and/or other state or regional food regulatory agencies.

In some embodiments, the food product provided herein comprises at least 0.000075%, at least 0.0001%, 0.00025%, at least 0.0005%, at least 0.00075%, at least 0.001%, at least 0.0025%, at least 0.005%, at least 0.0075%, at least 0.01%, at least 0.025%, at least 0.05%, at least 0.075%, at least 0.1%, at least 0.25%, at least 0.5%, at least 0.75%, at least 1%, at least 2.5%, at least 5%, at least 7.5%, at least 10%, at least 12.5%, at least 15%, at least 17.5%, at least 20%, at least 22.5%, at least 25%, at least 27.5%, at least 30%, at least 32.5%, at least 35%, at least 37.5.%, at least 40%, at least 42.5%, at least 45%, at least 47.5%, at least 50%, at least 52.5%, at least 55%, at least 57.5%, at least 60%, at least 62.5%, at least 65%, at least 67.5%, at least 70%, at least 72.5%, at least 75%, at least 77.5%, at least 80%, at least 82.5%, at least 85%, at least 87.5%, at least 90%, at least 92.5%, at least 95%, at least 97.5%, or 100% by weight of one or more recombinant components (e.g., any of the recombinant components disclosed herein) produced by one or more recombinant microbial host cells provided herein.

In some embodiments, the food product provided herein is essentially free of an esterase activity (e.g., activity of any one esterase disclosed herein or activities of any combination of at least two esterases disclosed herein).

In some embodiments, the food product is principally or entirely composed of components derived from non-animal sources. In alternative embodiments, the food product is composed of components partially derived from animal sources but supplemented with components derived from non-animal sources. In some such embodiments, the food product comprises between 5% and 100%, 90%, 80%, 70%, 60%, 50%, 40%, 30%, 20%, or 10%; between 10% and 100%, 90%, 80%, 70%, 60%, 50%, 40%, 30%, or 20%; between 20% and 100%, 90%, 80%, 70%, 60%, 50%, 40%, or 30%; between 30% and 100%, 90%, 80%, 70%, 60%, 50%, or 40%; between 40% and 100%, 90%, 80%, 70%, 60%, or 50%; between 50% and 100%, 90%, 80%, 70%, or 60%; between 60% and 100%, 90%, 80%, or 70%; between 70% and 100%, 90%, or 80%; between 80% and 100%, or 90%; or between 90% and 100% by weight of components derived from non-animal sources.

In various embodiments, the food product is a food product selected from any of the food product categories defined by the National Health and Nutrition Examination Survey, or resembles such food product (i.e., is a food product substitute).

Non-limiting examples of such food product categories (and non-limiting examples of such food products) include snack foods and gums (e.g., snack bars, crackers, salty snacks from grain products, chewing gums); breads, grains, and pastas (e.g., oat breads and rolls, cornbread, corn muffins, tortillas, flour and dry mixes, biscuits, multi-grain breads and rolls, whole wheat breads and rolls, pastas, rye breads and rolls, cracked wheat breads and rolls, white breads and rolls); beverages (e.g., beers and ales, beverage concentrates, beverages, energy drinks, sports drinks, fluid replacements, soft drinks, carbonated beverages, juices, wines, cocktails, nutrition drinks, nutrition powders); sweets and desserts (e.g., cakes, candies, chips, cookies, cobblers, pastries, ices or popsicles, muffins, pies, sugar replacements or substitutes, syrups, honey, jellies, jams, preserves, salads, crepes, Danish, breakfast pastries, doughnuts); breakfast foods (e.g., cereal grains, cereal, rice, French toast, pancakes, waffles, coffee cake); eggs (e.g., egg dishes, egg soups, mixtures made with egg whites, egg substitutes, mixtures made with egg substitutes); dairy products; salad dressings, oils, sauces, condiments (e.g., cooking fats, vegetable oils, salad dressings, tomato sauces, gravies); potatoes (e.g., potato salad, potato soups, chips and sticks, fried potatoes, mashed potatoes, stuffed potatoes, puffs); and soups (e.g., vegetable soups, vegetable broths), meals, main dishes, proteins (e.g., meat substitutes), and seafoods.

In some such embodiments, the food product provided herein is a dairy product or resembles a dairy product (i.e., is a dairy product substitute). The term "dairy product" as used herein refers to milk (e.g., whole milk (at least 3.25% milk fat), partly skimmed milk (from 1% to 2% milk fat), skim milk (less than 0.2% milk fat), cooking milk, condensed milk, flavored milk, goat milk, sheep milk, dried milk, evaporated milk, milk foam), and products derived from milk, including but not limited to yogurt (e.g., whole milk yogurt (at least 6 grams of fat per 170 g), low-fat yogurt (between 2 and 5 grams of fat per 170 g), nonfat yogurt (0.5 grams or less of fat per 170 g), greek yogurt (strained yogurt with whey removed), whipped yogurt, goat milk yogurt, Labneh (labne), sheep milk yogurt, yogurt drinks (e.g., whole milk Kefir, low-fat milk Kefir), Lassi), cheese (e.g., whey cheese such as ricotta; pasta filata cheese such as mozzarella; semi-soft cheese such as Havarti and Muenster; medium-hard cheese such as Swiss and Jarlsberg; hard cheese such as Cheddar and Parmesan; washed curd cheese such as Colby and Monterey Jack; soft ripened cheese such as Brie and Camembert; fresh cheese such as cottage cheese, feta cheese, cream cheese, and curd; processed cheese; processed cheese food; processed cheese product; processed cheese spread; enzyme-modulated cheese; cold-pack cheese), dairy-based sauces (e.g., fresh, frozen, refrigerated, or shelf stable), dairy spreads (e.g., low-fat spread, low-fat butter), cream (e.g., dry cream, heavy cream, light cream, whipping cream, half-and-half, coffee whitener, coffee creamer, sour cream, crème fraiche), frozen confections (e.g., ice cream, smoothie, milk shake, frozen yogurt, sundae, gelato, custard), dairy desserts (e.g., fresh, refrigerated, or frozen), butter (e.g., whipped butter, cultured butter), dairy powders (e.g., whole milk powder, skim milk powder, fat-filled milk powder (i.e., milk powder comprising plant fat in place of all or some animal fat), infant formula, milk protein concentrate (i.e., protein content of at least 80% by weight), milk protein isolate (i.e., protein content of at least 90% by weight), whey protein concentrate, whey protein isolate, demineralized whey protein concentrate, demineralized whey protein concentrate, β-lactoglobulin concentrate, β-lactoglobulin isolate, α-lactalbumin concentrate, α-lactalbumin isolate, glycomacropeptide concentrate, glycomacropeptide isolate, casein concentrate, casein isolate, nutritional supplements, texturizing blends, flavoring blends, coloring blends), ready-to-drink or ready-to-mix products (e.g., fresh, refrigerated, or shelf stable dairy protein beverages, weight loss beverages, nutritional beverages, sports recovery beverages, and energy drinks), puddings, gels, chewables, crisps, and bars.

The term "food product substitute" (e.g., "dairy product substitute") as used herein refers to a food product that resembles a conventional food product (e.g., can be used in place of the conventional food product). Such resemblance can be due to any physical, chemical, or functional attribute. In some embodiments, the resemblance of the food product provided herein to a conventional food product is due to a physical attribute. Non-limiting examples of physical attributes include color, shape, mechanical characteristics (e.g., hardness, G' storage modulus value, shape retention, cohesion, texture (i.e., mechanical characteristics that are correlated with sensory perceptions (e.g., mouthfeel, fattiness, creaminess, homogenization, richness, smoothness, thickness), viscosity, and crystallinity. In some embodiments, the resemblance of the food product provided herein and a conventional food product is due to a chemical/biological attribute. Non-limiting examples of chemical attributes include nutrient content (e.g., type and/or amount of amino acids (e.g., PDCAAS score), type and/or amount of lipids, type and/or amount of carbohydrates, type and/or amount of minerals, type and/or amount of vitamins), pH, digestibility, shelf-life, hunger and/or satiety regulation, taste, and aroma. In some embodiments, the resemblance of the food product provided herein to a conventional food product is due to a functional attribute. Non-limiting examples of functional attributes include gelling/agglutination behavior (e.g., gelling capacity (i.e., time required to form a gel (i.e., a protein network with spaces filled with solvent linked by hydrogen bonds to the protein molecules) of maximal strength in response to a physical and/or chemical condition (e.g., agitation, temperature, pH, ionic strength, protein concentration, sugar concentration, ionic strength)), agglutination capacity (i.e., capacity to form a precipitate (i.e., a tight protein network based on strong interactions between protein molecules and exclusion of solvent) in response to a physical and/or chemical condition), gel strength (i.e., strength of gel formed, measured in force/unit area (e.g., pascal (Pa))), water holding capacity upon gelling, syneresis upon gelling (i.e., water weeping over time)), foaming behavior (e.g., foaming capacity (i.e., amount of air held in response to a physical and/or chemical condition), foam stability (i.e., half-life of foam formed in response to a physical and/or chemical condition), foam seep), thickening capacity, use versatility (i.e., ability to use the food product in a variety of manners and/or to derive a diversity of other compositions from the food product; e.g., ability to produce food products that resemble milk derivative products such as yoghurt, cheese, cream, and butter), and ability to form protein dimers.

In various embodiments, the food product provided herein is a milk substitute (i.e., resembles milk), yogurt substitute (i.e., resembles yoghurt), cheese substitute (i.e., resembles cheese), frozen desert substitute (i.e., resembles a frozen desert (e.g., ice cream)), or any other dairy product substitute (i.e., resembles a dairy product (e.g., any dairy product disclosed herein)).

Milk Protein Component

In some embodiments, the food product (e.g., dairy product, egg product) comprises a milk protein component, wherein the milk protein component comprises a recombinant milk protein and an essentially eliminated or modulated activity of an esterase compared to the esterase activity of a milk protein component that is not produced according to a method provided herein (i.e., is not produced by a method that comprises at least one step in which activity of an esterase is essentially eliminated or modulated). The term "milk protein component" as used herein refers to a component that consists of a subset of whey proteins or a subset of caseins or a mixture of a subset of whey proteins and a subset of caseins (i.e., from just some but not all proteins present in a whey protein concentrate or a micellar casein concentrate, or a sodium caseinate, or an acid casein, or a milk protein concentrate or a milk protein isolate). The term furthermore implies that the milk proteins in the milk protein component are the only milk proteins comprised in the food product (i.e., the food product comprises no other milk proteins other than the milk proteins of which the milk protein component consists).

In some embodiments, the food product provided herein comprises between 0.1% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, 1%, 0.9%, 0.8%, 0.7%, 0.6%, 0.5%, 0.4%, 0.3%, or 0.2%; between 0.2% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, 1%, 0.9%, 0.8%, 0.7%, 0.6%, 0.5%, 0.4%, or 0.3%; between 0.3% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, 1%, 0.9%, 0.8%, 0.7%, 0.6%, 0.5%, or 0.4%; between 0.4% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, 1%, 0.9%, 0.8%, 0.7%, 0.6%, or 0.5%; between 0.5% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, 1%, 0.9%, 0.8%, 0.7%, or 0.6%; between 0.6% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, 1%, 0.9%, 0.8%, or 0.7%; between 0.7% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, 1%, 0.9%, or 0.8%; between 0.8% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, 1%, or 0.9%; between 0.9% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, 2%, or 1%; between 1% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, 3%, or 2%; between 2% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, 4%, or 3%; between 3% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, 5%, or 4%; between 4% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, 6%, or 5%; between 5% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, 7%, or 6%; between 6% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, 8%, or 7%; between 7% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, 9%, or 8%; between 8% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, 10%, or 9%; between 9% and 100%, 95%, 90%, 85%, 80%, 75%, 70%, 65%, 60%, 55%, 50%, 45%, 40%, 35%, 30%, 25%, 20%, 15%, 14%, 13%, 12%, 11%, or 10%; between 10% and 100%, 95%, 90%, 85%, 80%, 75%, 70%, 65%, 60%, 55%, 50%, 45%, 40%, 35%, 30%, 25%, 20%, 15%, 14%, 13%, 12%, or 11%; between 11% and 100%, 95%, 90%, 85%, 80%, 75%, 70%, 65%, 60%, 55%, 50%, 45%, 40%, 35%, 30%, 25%, 20%, 15%, 14%, 13%, or 12%; between 12% and 100%, 95%, 90%, 85%, 80%, 75%, 70%, 65%, 60%, 55%, 50%, 45%, 40%, 35%, 30%, 25%, 20%, 15%, 14%, or 13%; between 13% and 100%, 95%, 90%, 85%, 80%, 75%, 70%, 65%, 60%, 55%, 50%, 45%, 40%, 35%, 30%, 25%, 20%, 15%, or 14%; between 14% and 100%, 95%, 90%, 85%, 80%, 75%, 70%, 65%, 60%, 55%, 50%, 45%, 40%, 35%, 30%, 25%, 20%, or 15%; between 15% and 100%, 95%, 90%, 85%, 80%, 75%, 70%, 65%, 60%, 55%, 50%, 45%, 40%, 35%, 30%, 25%, or 20%; between 20% and 100%, 95%, 90%, 85%, 80%, 75%, 70%, 65%, 60%, 55%, 50%, 45%, 40%, 35%, 30%, or 25%; between 25% and 100%, 95%, 90%, 85%, 80%, 75%, 70%, 65%, 60%, 55%, 50%, 45%, 40%, 35%, or 30%; between 30% and 100%, 95%, 90%, 85%, 80%, 75%, 70%, 65%, 60%, 55%, 50%, 45%, 40%, or 35%; between 35% and 100%, 95%, 90%, 85%, 80%, 75%, 70%, 65%, 60%, 55%, 50%, 45%, or 40%; between 40% and 100%, 95%, 90%, 85%, 80%, 75%, 70%, 65%, 60%, 55%, 50%, or 45%; between 45% and 100%, 95%, 90%, 85%, 80%, 75%, 70%, 65%, 60%, 55%, or 50%; between 50% and 100%, 95%, 90%, 85%, 80%, 75%, 70%, 65%, 60%, or 55%; between 55% and 100%, 95%, 90%, 85%, 80%, 75%, 70%, 65%, or 60%; between 60% and 100%, 95%, 90%, 85%, 80%, 75%, 70%, or 65%; between 65% and 100%, 95%, 90%, 85%, 80%, 75%, or 70%; between 70% and 100%, 95%, 90%, 85%, 80%, or 75%; between 75% and 100%, 95%, 90%, 85%, or 80%; between 80% and 100%, 95%, 90%, or 85%; or between 85% and 100%, 95%, 90%; between 90% and 100% or 95%, or between 95% and 100% by weight of the milk protein component.

The milk protein component comprised in the food product provided herein can consist of one or more (e.g., two, three, four, five, six, seven, eight, nine, ten, or more) milk proteins (e.g., one or more whey proteins, one or more caseins, or a mixture of one or more whey proteins and one or more caseins), wherein at least one of the milk proteins is a recombinant milk protein (e.g., any of the recombinant milk proteins disclosed herein) produced by a recombinant microbial host cell.

In some embodiments, the milk protein component comprised in the food product provided herein consists of one or more (e.g., two, three, four, or more) whey proteins (e.g., a β-lactoglobulin, a α-lactalbumin, a mixture of a β-lactoglobulin and an α-lactalbumin, a mixture of two or more β-lactoglobulin having different post-translational modification (PTMs), a mixture of two or more α-lactalbumin having different PTMs, a mixture of two or more β-lactoglobulin having different PTMs and an α-lactalbumin, a mixture of two or more α-lactalbumin having different PTMs and a β-lactoglobulin, a mixture of two or more β-lactoglobulin having different PTMs and a mixture of two or more α-lactalbumin having different PTMs); one or more (e.g., two, three, four, or more) caseins (e.g., a κ-casein, a β-casein, a γ-casein, a mixture of a κ-casein and a β-casein, a mixture of a κ-casein and a γ-casein, a mixture of a β-casein and a γ-casein, a mixture of two or more κ-casein having different PTMs, a mixture of two or more β-casein having different PTMs, a mixture of two or more γ-casein having different PTMs, a mixture of two or more κ-casein having different PTMs and a β-casein, a mixture of two or more κ-casein having different PTMs and a γ-casein, a mixture of two or more β-casein having different PTMs and a κ-casein, a mixture of two or more β-casein having different PTMs and a γ-casein, a mixture of two or more γ-casein having different PTMs and a κ-casein, a mixture of two or more γ-casein having different PTMs and a β-casein, a mixture of two or more κ-casein having different PTMs and/or two or more β-casein having different PTMs and/or two or more γ-casein having different PTMs); or any combination thereof.

The at least one recombinant milk protein can be a single recombinant milk protein. The single recombinant milk protein can be a single recombinant whey protein (e.g., a recombinant β-lactoglobulin or a recombinant α-lactalbumin) or a single recombinant casein (e.g., a recombinant κ-casein or a recombinant β-casein or a recombinant γ-casein). Alternatively, the at least one recombinant milk protein can be two or more recombinant milk proteins. The two or more recombinant milk proteins can be two or more recombinant whey proteins (e.g., a recombinant β-lactoglobulin and a recombinant α-lactalbumin), two or more recombinant caseins (e.g., a recombinant κ-casein and a recombinant β-casein, a recombinant κ-casein and a recombinant γ-casein, a recombinant κ-casein and a recombinant β-casein and a recombinant γ-casein), or a mixture of at least one recombinant whey protein and at least one recombinant casein (e.g., one or both of a recombinant β-lactoglobulin and a recombinant α-lactalbumin in combination with one or two or all of a recombinant κ-casein and a recombinant β-casein and a recombinant γ-casein).

In some embodiments, the at least one recombinant milk protein comprises at least one recombinant milk protein that has a PTM. In various such embodiments, the PTM can be a native PTM, a non-native PTM, or a mixture thereof. In some embodiments, the type and/or number of PTMs of the recombinant milk protein confers a desirable attribute on the food product provided herein.

In some embodiments, the milk protein component comprised in the food product provided herein comprises one or more (e.g., two, three, four, or more) recombinant whey protein (e.g., a recombinant β-lactoglobulin, a recombinant α-lactalbumin, a mixture of a recombinant β-lactoglobulin and a recombinant α-lactalbumin, a mixture of two or more recombinant β-lactoglobulin having different PTMs, a mixture of two or more recombinant α-lactalbumin having different PTMs, a mixture of two or more recombinant β-lactoglobulin having different PTMs and a recombinant α-lactalbumin, a mixture of two or more recombinant α-lactalbumin having different PTMs and a β-lactoglobulin, a mixture of two or more recombinant β-lactoglobulin having different PTMs and a mixture of two or more recombinant α-lactalbumin having different PTMs); one or more (e.g., two, three, four, or more) recombinant casein (e.g., a recombinant κ-casein, a recombinant β-casein, a recombinant γ-casein, a mixture of a recombinant κ-casein and a recombinant β-casein, a mixture of a recombinant κ-casein and a recombinant γ-casein, a mixture of a recombinant β-casein and a recombinant γ-casein, a mixture of two or more recombinant κ-casein having different PTMs, a mixture of two or more recombinant β-casein having different PTMs, a mixture of two or more recombinant γ-casein having different PTMs, a mixture of two or more recombinant κ-casein having different PTMs and a recombinant β-casein, a mixture of two or more recombinant κ-casein having different PTMs and a γ-casein, a mixture of two or more recombinant β-casein having different PTMs and a recombinant κ-casein, a mixture of two or more recombinant β-casein having different PTMs and a γ-casein, a mixture of two or more recombinant γ-casein having different PTMs and a recombinant κ-casein, a mixture of two or more recombinant γ-casein having different PTMs and a β-casein, a mixture of two or more recombinant κ-casein having different PTMs and/or two or more recombinant β-casein having different PTMs and/or two or more recombinant γ-casein having different PTMs); or any combination thereof.

In some embodiments, the milk protein component comprised in the food product provided herein consists of one or more (e.g., two, three, four, or more) recombinant whey protein (e.g., a recombinant β-lactoglobulin, a recombinant α-lactalbumin, a mixture of a recombinant β-lactoglobulin and a recombinant α-lactalbumin, a mixture of two or more recombinant β-lactoglobulin having different PTMs, a mixture of two or more recombinant α-lactalbumin having different PTMs, a mixture of two or more recombinant β-lactoglobulin having different PTMs and a recombinant α-lactalbumin, a mixture of two or more recombinant α-lactalbumin having different PTMs and a β-lactoglobulin, a mixture of two or more recombinant β-lactoglobulin having different PTMs and a mixture of two or more recombinant α-lactalbumin having different PTMs); one or more (e.g., two, three, four, or more) recombinant casein (e.g., a recombinant κ-casein, a recombinant β-casein, a recombinant γ-casein, a mixture of a recombinant κ-casein and a recombinant β-casein, a mixture of a recombinant κ-casein and a recombinant γ-casein, a mixture of a recombinant β-casein and a recombinant γ-casein, a mixture of two or more recombinant κ-casein having different PTMs, a mixture of two or more recombinant β-casein having different PTMs, a mixture of two or more recombinant γ-casein having different PTMs, a mixture of two or more recombinant κ-casein having different PTMs and a recombinant β-casein, a mixture of two or more recombinant κ-casein having different PTMs and a γ-casein, a mixture of two or more recombinant β-casein having different PTMs and a recombinant κ-casein, a mixture of two or more recombinant β-casein having different PTMs and a γ-casein, a mixture of two or more recombinant γ-casein having different PTMs and a recombinant κ-casein, a mixture of two or more recombinant γ-casein having different PTMs and a β-casein, a mixture of two or more recombinant κ-casein having different PTMs and/or two or more recombinant β-casein having different PTMs and/or two or more recombinant γ-casein having different PTMs); or any combination thereof.

The milk protein component can further comprise one or more native milk proteins. In some embodiments, the milk protein component comprised in the food product provided herein comprises one or more (e.g., two, three, four, or more) native whey protein (e.g., a native β-lactoglobulin, a native α-lactalbumin, a mixture of a native β-lactoglobulin and a native α-lactalbumin, a mixture of two or more native β-lactoglobulin having different PTMs, a mixture of two or more native α-lactalbumin having different PTMs, a mixture of two or more native β-lactoglobulin having different PTMs and a native α-lactalbumin, a mixture of two or more native α-lactalbumin having different PTMs and a native β-lactoglobulin, a mixture of two or more native β-lactoglobulin having different PTMs and a mixture of two or more native α-lactalbumin having different PTMs); one or more (e.g., two, three, four, or more) native casein (e.g., a native κ-casein, a native β-casein, a native γ-casein, a mixture of a native κ-casein and a native β-casein, a mixture of a native κ-casein and a native γ-casein, a mixture of a native β-casein and a native γ-casein, a mixture of two or more native κ-casein having different PTMs, a mixture of two or more native β-casein having different PTMs, a mixture of two or more native γ-casein having different PTMs, a mixture of two or more native κ-casein having different PTMs and a native β-casein, a mixture of two or more native κ-casein having different PTMs and a native γ-casein, a mixture of two or more native β-casein having different PTMs and a native κ-casein, a mixture of two or more native β-casein having different PTMs and a native γ-casein, a mixture of two or more native γ-casein having different PTMs and a native κ-casein, a mixture of two or more native γ-casein having different PTMs and a native β-casein, a mixture of two or more native κ-casein having different PTMs and/or two or more native β-casein having different PTMs and/or two or more native γ-casein having different PTMs); of any combination thereof.

In some such embodiments, the milk protein component comprised in the food product provided herein consists of whey protein and casein at a weight ratio of between about 10 to about 1 and about 1 to about 10 (e.g., about 10 to 1, about 9 to 1, about 8 to 1, about 7 to 1, about 6 to 1, about 5 to 1, about 4 to 1, about 3 to 1, about 2 to 1, about 1 to 1, about 1 to 2, about 1 to 3, about 1 to 4, about 1 to 5, about 1 to 6, about 1 to 7, about 1 to 8, about 1 to 9, or about 1 to 10).

In some such embodiments, the milk protein component comprised in the food product provided herein consists of recombinant whey protein and native whey protein at a weight ratio of between about 10 to about 1 and about 1 to about 10 (e.g., about 10 to 1, about 9 to 1, about 8 to 1, about 7 to 1, about 6 to 1, about 5 to 1, about 4 to 1, about 3 to 1, about 2 to 1, about 1 to 1, about 1 to 2, about 1 to 3, about 1 to 4, about 1 to 5, about 1 to 6, about 1 to 7, about 1 to 8, about 1 to 9, or about 1 to 10).

In some such embodiments, the milk protein component comprised in the food product provided herein consists of recombinant casein and native casein at a weight ratio of between about 10 to about 1 and about 1 to about 10 (e.g., about 10 to 1, about 9 to 1, about 8 to 1, about 7 to 1, about 6 to 1, about 5 to 1, about 4 to 1, about 3 to 1, about 2 to 1, about 1 to 1, about 1 to 2, about 1 to 3, about 1 to 4, about 1 to 5, about 1 to 6, about 1 to 7, about 1 to 8, about 1 to 9, or about 1 to 10).

In some such embodiments, the milk protein component comprised in the food product provided herein consists of recombinant whey protein and recombinant casein at a weight ratio of between about 10 to about 1 and about 1 to about 10 (e.g., about 10 to 1, about 9 to 1, about 8 to 1, about 7 to 1, about 6 to 1, about 5 to 1, about 4 to 1, about 3 to 1, about 2 to 1, about 1 to 1, about 1 to 2, about 1 to 3, about 1 to 4, about 1 to 5, about 1 to 6, about 1 to 7, about 1 to 8, about 1 to 9, or about 1 to 10).

In some such embodiments, the milk protein component comprised in the food product provided herein consists of native whey protein and native casein at a weight ratio of between about 10 to about 1 and about 1 to about 10 (e.g., about 10 to 1, about 9 to 1, about 8 to 1, about 7 to 1, about 6 to 1, about 5 to 1, about 4 to 1, about 3 to 1, about 2 to 1, about 1 to 1, about 1 to 2, about 1 to 3, about 1 to 4, about 1 to 5, about 1 to 6, about 1 to 7, about 1 to 8, about 1 to 9, or about 1 to 10).

In some such embodiments, the milk protein component comprised in the food product provided herein consists of recombinant milk protein and native milk protein at a weight ratio of between about 10 to about 1 and about 1 to about 10 (e.g., about 10 to 1, about 9 to 1, about 8 to 1, about 7 to 1, about 6 to 1, about 5 to 1, about 4 to 1, about 3 to 1, about 2 to 1, about 1 to 1, about 1 to 2, about 1 to 3, about 1 to 4, about 1 to 5, about 1 to 6, about 1 to 7, about 1 to 8, about 1 to 9, or about 1 to 10).

In all embodiments, the milk protein component consists of only a subset of whey proteins, or of a subset of caseins, or of a mixture of a subset of whey proteins and a subset of caseins. In some embodiments, the subset of whey proteins consists of a β-lactoglobulin and/or a α-lactalbumin. In some embodiments, the subset of caseins consists of a κ-casein and/or a β-casein and/or a γ-casein. In various embodiments, the mixture of a subset of whey proteins and a subset of caseins consists of a β-lactoglobulin and/or a α-lactalbumin in combination with a κ-casein and/or a β-casein and/or a γ-casein. In some such embodiments, the mixture consists of a β-lactoglobulin and a κ-casein. In other such embodiments, the mixture consists of a α-lactalbumin and a κ-casein. In yet other such embodiments, the mixture consists of a β-lactoglobulin and an α-lactalbumin and a κ-casein.

Non-Milk Protein Component

In some embodiments, the food product (e.g., dairy product, egg product) comprises a non-milk protein component, wherein the non-milk protein component comprises a recombinant non-milk protein and an essentially eliminated or modulated activity of an esterase compared to the esterase activity of a non-milk protein component that is not produced according to a method provided herein (i.e., is not produced by a method that comprises at least one step in which activity of an esterase is essentially eliminated or modulated).

The non-milk protein component comprised in the food product provided herein can comprise non-milk proteins derived from any source, as well as mixtures of non-milk proteins derived from various sources. Non-limiting examples of such sources include animals, plants, algae, fungi, and microbes.

Non-limiting examples of animals include insects (e.g., fly), mammals (e.g. cow, sheep, goat, rabbit, pig, human), and birds (e.g., chicken).

Non-limiting examples of plants include cycads, *Ginkgo biloba*, conifers, cypress, junipers, *thuja*, cedarwood, pines, *angelica*, caraway, coriander, cumin, fennel, parsley, dill, dandelion, helichrysum, marigold, mugwort, safflower, camomile, lettuce, wormwood, calendula, citronella, sages, thyme, chia seed, mustard, olive, coffee, *capsicum*, eggplant, paprika, cranberry, kiwi, vegetable plants (e.g., carrot, celery), *tagetes*, tansy, tarragon, sunflower, wintergreen, basil, hyssop, lavender, lemon *verbena*, marjoram, melissa, patchouli, pennyroyal, peppermint, rosemary, sesame, spearmint, primroses, samara, pepper, pimento, potato, sweet potato, tomato, blueberry, nightshades, *petunia*, morning glory, lilac, jasmin, honeysuckle, snapdragon, *psyllium*, wormseed, buckwheat, amaranth, chard, *quinoa*, spinach, rhubarb, jojoba, cypselea, *chlorella*, marula, hazelnut, canola, kale, bok choy, rutabaga, frankincense, myrrh, elemi, hemp, pumpkin, squash, curcurbit, manioc, *dalbergia*, legume plants (e.g., alfalfa, lentils, beans, clovers, peas, fava coceira, frijole bola roja, frijole negro, *lespedeza*, licorice, lupin, mesquite, carob, soybean, peanut, tamarind, *wisteria*, *cassia*, chickpea/garbanzo, fenugreek, green pea, yellow pea, snow pea, lima bean, fava bean), geranium, flax, pomegranate, cotton, okra, neem, fig, mulberry, clove, *eucalyptus*, tea tree, niaouli, fruiting plants (e.g., apple, apricot, peach, plum, pear, nectarine), strawberry, blackberry, raspberry, cherry, prune, rose, tangerine, citrus (e.g., grapefruit, lemon, lime, orange, bitter orange, mandarin), mango, citrus bergamot, buchu, grape, broccoli, brussels sprout, camelina, cauliflower, rape, rapeseed (canola), turnip, cabbage, cucumber, watermelon, honeydew melon, zucchini, birch, walnut, cassava, baobab, allspice, almond, breadfruit, sandalwood, macadamia, taro, tuberose, aloe vera, garlic, onion, shallot, vanilla, *yucca*, vetiver, galangal, barley, corn, *curcuma aromatica*, ginger, lemon grass, oat, palm, pineapple, rice, rye, sorghum, triticale, turmeric, yam, bamboo, barley, cajuput, *canna*, cardamom, maize, oat, wheat, cinnamon, *sassafras, lindera benzoin*, bay laurel, avocado, ylang-ylang, mace, nutmeg, moringa, horsetail, oregano, cilantro, chervil, chive, aggregate fruits, grain plants, herbal plants, leafy vegetables, non-grain legume plants, nut plants, succulent plants, land plants, water plants, delbergia, millets, drupes, schizocarps, flowering plants, non-flowering plants, cultured plants, wild plants, trees, shrubs, flowers, grasses, herbaceous plants, brushes, lianas, cacti, tropical plants, subtropical plants, temperate plants, and derivatives and crosses thereof.

Non-limiting examples of algae include green algae (e.g., *Chlorella vulgaris, Chlorealla pyrenoidosa*), brown algae (e.g., *Alaria marginata, Analipus japonicus, Ascophyllum nodosum, Ecklonia* sp, *Eisenia bicyclis, Hizikia fusiforme, Kjellmaniella gyrata, Laminaria angustata, Laminaria longirruris, Laminaria Longissima, Laminaria ochotensis, Laminaria claustonia, Laminaria saccharina, Laminaria digitata, Laminaria japonica, Macrocystis pyrifera, Petalonia fascia, Scytosiphon lome*), red algae (e.g., *Chondrus crispus, Chondrus ocellatus, Eucheuma cottonii, Eucheuma spinosum, Furcellaria fastigiata, Gracilaria bursa-pastoris, Gracilaria lichenoides, Gloiopeltis furcata, Gigartina acicularis, Gigartina bursa-pastoris, Gigartina pistillata, Gigartina radula, Gigartina skottsbergii, Gigartina stellata, Palmaria palmata, Porphyra columbina, Porphyra crispata, Porhyra deutata, Porhyra perforata, Porhyra suborbiculata, Porphyra tenera, Porphyridium cruentum, Porphyridium purpureum, Porphyridium aerugineum, Rhodella maculate, Rhodella reticulata, Rhodella violacea, Rhodymenia palmata*), and derivatives and crosses thereof.

Non-limiting examples of fungi include *Aspergillus nidulans, Aspergillus niger, Aspergillus niger* var. *awamori, Aspergillus oryzae, Candida albicans, Candida etchellsii, Candida guilliermondii, Candida humilis, Candida lipolytica, Candida pseudotropicalis, Candida utilis, Candida versatilis, Chrysosporium lucknowense, Debaryomyces hansenii, Endothia parasitica, Eremothecium ashbyii, Fusarium gramineum, Fusarium moniliforme, Fusarium venenatum, Hansenula polymorpha, Kluyveromyces lactis, Kluyveromyces marxianus, Kluyveromyces marxianus* var. *lactis, Kluyveromyces thermotolerans, Morteirella vinaceae* var. *raffinoseutilizer, Mucor miehei, Mucor miehei* var. Cooney et Emerson, *Mucor pusillus* Lindt, *Myceliophthora thermophile, Neurospora crassa, Penicillium roquefortii, Physcomitrella patens, Pichia pastoris, Pichia finlandica, Pichia trehalophila, Pichia koclamae, Pichia membranaefaciens, Pichia minuta, Ogataea minuta, Pichia lindneri, Pichia opuntiae, Pichia thermotolerans, Pichia salictaria, Pichia guercuum, Pichia pijperi, Pichia stiptis, Pichia methanolica, Rhizopus niveus, Saccharomyces bayanus, Saccharomyces beticus, Saccharomyces cerevisiae, Saccharomyces chevaliers, Saccharomyces diastaticus, Saccharomyces ellipsoideus, Saccharomyces exiguus, Saccharomyces florentinus, Saccharomyces fragilis, Saccharomyces pastorianus, Saccharomyces pombe, Saccharomyces sake, Saccharomyces uvarum, Sporidiobolus johnsonii, Sporidiobolus salmonicolor, Sporobolomyces roseus, Trichoderma reesei, Xanthophyllomyces dendrorhous, Yarrowia lipolytica, Zygosaccharomyces rouxii*, and derivatives and crosses thereof.

Non-limiting examples of microbes include firmicutes, cyanobacteria (blue-green algae), oscillatoriophcideae, bacillales, lactobacillales, oscillatoriales, bacillaceae, lactobacillaceae, *Acetobacter* suboxydans, *Acetobacter xylinum, Actinoplane missouriensis, Arthrospira platensis, Arthrospira maxima, Bacillus cereus, Bacillus coagulans, Bacillus subtilus, Bacillus cerus, Bacillus licheniformis, Bacillus stearothermophilus, Bacillus subtilis, Escherichia coli, Lactobacillus acidophilus, Lactobacillus bulgaricus, Lactococcus lactis, Lactococcus lactis* Lancefield Group N, *Lactobacillus reuteri, Leuconostoc citrovorum, Leuconostoc dextranicum, Leuconostoc mesenteroides, Micrococcus lysodeikticus, Spirulina, Streptococcus cremoris, Streptococcus lactis, Streptococcus lactis* subspecies *diacetylactis, Streptococcus thermophilus, Streptomyces chattanoogensis, Streptomyces griseus, Streptomyces natalensis, Streptomyces olivaceus, Streptomyces olivochromogenes, Streptomyces rubiginosus, Tetrahymena thermophile, Tetrahymena hegewischi, Tetrahymena hyperangularis, Tetrahymena malaccensis, Tetrahymena pigmentosa, Tetrahymena pyriformis, Tetrahymena vorax, Xanthomonas campestris*, and derivatives and crosses thereof.

In some embodiments, the non-milk protein is an animal protein. Non-limiting examples of such proteins include collagen.

In some embodiments, the non-milk protein is a plant protein. Non-limiting examples of such non-milk plant proteins include pea proteins and potato proteins.

In some embodiments, the non-milk protein is a fungal protein. Non-limiting examples of such proteins include glucoamylase, xylanase, amylase, glucanase, member of the SUN family (Sim1p, Uth1p, Nca3p, Sun4p), elongation factor 1-alpha, mitochondrial leucyl-tRNA synthetase, alpha-amylase, alpha-galactosidase, cellulase, endo-1,4-beta-xylanase, endoglucanase, exo-1,4-beta-xylosidase, glucoamylase, peptidase, aspergillopepsin-1,1,4-beta-D-glucan cellobiohydrolase A, alpha-galactosidase A, alpha-galactosidase B, alpha-galactosidase D, alpha-glucuronidase A, beta-galactosidase C, glucan 1,3-beta-glucosidase A, hydrophobin, and glucan endo-1,3-beta-glucosidase eglC.

In some embodiments, the non-milk protein is derived from a non-milk protein that is secreted by a host cell (e.g., any of the animal, plant, algae, fungal, or microbial native or recombinant host cells disclosed herein). Suitable secreted non-milk proteins can be identified, for example, by obtaining a secretome (i.e., secreted proteins, obtained by, for example, culturing animal, plant, algae, fungal, or microbial cells in liquid culture, removing the cells from the cell culture (e.g., via centrifugation), and optionally concentrating the remaining culture medium; or by sequencing genomes and in silico identifying secreted proteins (see, for example, Mattanovich et al. 2009. Microbial Cell Factories 8:29), whole cell extracts, or fractionated whole cell extracts; optionally partially digesting, glycosylating, phosphorylating, or otherwise enzymatically treating the proteins; and then screening them in assays (e.g., high-throughput assays), e.g., for proteins that have similar, identical, or different properties compared to milk proteins). Suitable secreted non-milk proteins can also be identified by screening calcium-enriched fractions of soy proteins, e.g., for proteins that have similar, identical, or different properties compared to milk proteins. Non-limiting examples of suitable secreted non-milk proteins are provided in PCT filing PCT/US2017/48730 filed Aug. 25, 2017. In some embodiments, the non-milk protein is a secreted fungal protein (i.e., a protein that is secreted by a fungus (e.g., any of the fungi disclosed herein)).

In some embodiments, the non-milk protein component comprises a recombinant non-milk protein. In some such embodiments, the recombinant non-milk protein has a non-native PTM and/or lacks an epitope that can elicit an immune response in a human or animal.

Other Components

The food product provided herein may further comprise one or more other components. For example, in some embodiments the food product provided herein further comprises a lipid. Non-limiting examples of lipids include lipids selected from the group consisting of fats, oils, monoglycerides, diglycerides, triglycerides, phospholipids, and free fatty acids.

Non-limiting examples of oils include plant oils (e.g., sunflower oil, coconut oil, mustard oil, peanut oil, canola oil, corn oil, cottonseed oil, flax seed oil, olive oil, palm oil, rapeseed oil, safflower oil, sesame oil, soybean oil, almond oil, beech nut oil, brazil nut oil, cashew oil, hazelnut oil, macadamia nut oil, mongongo nut oil, pecan oil, pine nut oil, pistachio nut oil, walnut oil, avocado oil, grape oil), microbe-derived oils, algae-derived oils, fungus-derived oils, marine animal oils (e.g., Atlantic fish oil, Pacific fish oil, Mediterranean fish oil, light pressed fish oil, alkaline treated fish oil, heat treated fish oil, light and heavy brown fish oil, bonito oil, pilchard oil, tuna oil, sea bass oil, halibut oil, spearfish oil, barracuda oil, cod oil, menhaden oil, sardine oil, anchovy oil, capelin oil, Atlantic cod oil, Atlantic herring oil, Atlantic mackerel oil, Atlantic menhaden oil, salmonid oil, and shark oil, squid oil, cuttle fish oil, octopus oil, krill oil, seal oil, whale oil), non-essential oils, essential oils, natural oils, non-hydrogenated oils, partially hydrogenated oils, hydrogenated oils (e.g., hydrogenated coconut oil), crude oils, semi-refined (also called alkaline refined) oils, interesterified oils, and refined oils. In some embodiments, longer chain oils (e.g., sunflower oil, corn oil, olive oil, soy oil, peanut oil, walnut oil, almond oil, sesame oil, cottonseed oil, canola oil, safflower oil, flax seed oil, palm oil, palm kernel oil, palm fruit oil, coconut oil, babassu oil, shea butter, mango butter, cocoa butter, wheat germ oil, rice bran oil, engineered sunflower oil that over-expresses oleic acid by 400%) are combined with short-chain triglycerides to produce transesterified fatty acid esters. Various combinations of triglycerides and longer chain oils can be incorporated to create a number of different flavor profiles.

Non-limiting examples of monoglycerides and diglycerides include plant-derived monoglycerides and diglycerides, (e.g., monoglycerides and diglycerides derived from sunflower, coconut, peanut, cottonseed, olive, palm, rapeseed, safflower, sesame seed, soybean, almond, beech nut, Brazil nut, cashew, hazelnut, macadameia nut, mongongo nut, pecan, pine nut, pistachio, walnut, and avocado). The monoglycerides and diglycerides can include the acyl chain of any of the free fatty acids listed herein. Additional examples of monoglycerides and diglycerides are known in the art.

Non-limiting examples of free fatty acids include butyric acid, caproic acid, caprylic acid, capric acid, lauric acid, myristic acid, palmitic acid, stearic acid, arachidic acid, behenic acid, lignoceric acid, cerotic acid, myristoleic acid, pamitoleic acid, sapienic acid, oleic acid, elaidic acid, vaccenic acid, linoleic acid, linoelaidic acid, α-linolenic acid, arachidonic acid, eicosapentaenoic acid, erucic acid, docosahexaenoic acid, omega-fatty acids (e.g., arachidonic acid, omega-3-fatty acids, omega-6-fatty acids, omega-7-fatty acids, omega-9-fatty acids), fatty acids with even number of carbons of 4-16 carbons in length, monosaturated acids (particularly with 18 carbons), fatty acids with low interfacial tension (e.g., less than 20, less than 15, less than 11, less than 9, less than 7, less than 5, less than 3, less than 2, less than 1, or less than 0.5 dynes/cm, from 0.1 to 20, from 1 to 15, from 2 to 9, from 3 to 9, from 4 to 9, from 5 to 9, from 2 to 7, from 0.1 to 5, from 0.3 to 2, or from 0.5 to 1 dynes/cm, 0.1, 0.5, 1.0, 1.5, 2.0, 2.5, 3.0, 3.5, 4.0, 4.5, 5.0, 5.5, 6.0, 6.5, 7.0, 7.5, 8.0, 8.5, 9.0, 9.5, 10.0, 10.5, 11.0, 11.5, 12.0, 12.5, 13.0, 13.5, 14.0, 14.5, 15.0, 15.5, 16.0, 16.5, 17.0, 17.5, 18.0, 18.5, 19.0, 19.5, or 20.0), butyric (4:0) acid or caproic (6:0) acid that is esterified at sn-3, medium-chain fatty acids (8:0-14:0) as well as 16:0 that are esterified at positions sn-1 and sn-2, fatty acids in which stearic acid (18:0) is placed at position sn-1, fatty acids in which oleic acid (18:1) is placed at positions sn-1 and sn-3, fatty acids that have a range of carbon atoms (e.g, from 8 to 40, from 10 to 38, from 12 to 36, from 14 to 34, from 16 to 32, from 18 to 30, or from 20 to 28 carbon atoms), fatty acids that comprise at least one unsaturated bond (i.e., a carbon carbon double or triple bond; e.g., at least 2, at least 3, at least 4, at least 5, at least 6, at least 7, or at least 8 carbon-carbon double bonds and/or triple bonds), fatty acids with conjugated unsaturated bonds (i.e., at least one pair of carbon-carbon double and/or triple bonds are bonded together, without a methylene (CH2) group between them (e.g., 4CH:CHi CH:CHi)), and derivatives of the above named fatty acids (e.g., esters (e.g., methyl and ethyl esters), salts (e.g., sodium and potassium salts), triglyceride derivatives, diglycerides derivatives, monoglyceride derivatives). The free fatty acids can be saturated or unsaturated. In some embodiments, the free fatty acids are not derived from or produced by a mammal. Additional examples of free fatty acids are known in the art.

Non-limiting examples of phospholipids include lecithin phospholipids (e.g., soy lecithin phospholipids, sunflower lecithin phospholipids, cotton lecithin phospholipids, rapeseed lecithin phospholipids, rice bran lecithin phospholipids, corn lecithin phospholipids, flour lecithin phospholipids), cardiolipin, ceramide phosphocholines, ceramide phosphoethanolamines, glycerophospholipids, phasphatidicacid, phosphatidylcholine, phosphatidylethanolamine, phosphatidylinositol, phosphospingolipids, and phsophatidylserine. In some embodiments, the phospholipids are not derived from or produced by a mammal.

Non-limiting examples of triglycerides include tributyrin, short-chain triglycerides, short-chain triglycerides comprising three oleic acids; short-chain triglycerides comprising hexanoic acid; short-chain triglycerides comprising hexanoic acid and butyric acid; short-chain triglycerides comprising hexanoic acid and decanoic acid; and short-chain triglycerides comprising one butyric, one hexanoic, and one octanoic acid.

In some embodiments, the food product provided herein has a free lipid content of less than 0.3%, less than 0.25%, less than 0.2%, less than 0.15%, less than 0.1%, or less than 0.05%; between 0.05% and 3%, 2.6%, 2.2%, 1.8%, 1.4%, 1.0%, 0.6%, 0.2%, or 0.1%; between 0.1% and 3%, 2.6%, 2.2%, 1.8%, 1.4%, 1.0%, 0.6%, or 0.2%; between 0.2% and 3%, 2.6%, 2.2%, 1.8%, 1.4%, 1.0%, or 0.6%; between 0.6% and 3%, 2.6%, 2.2%, 1.8%, 1.4%, or 1.0%; between 1.0% and 3%, 2.6%, 2.2%, 1.8%, or 1.4%; between 1.4% and 3%, 2.6%, 2.2%, or 1.8%; between 1.8% and 3%, 2.6%, or 2.2%; between 2.2% and 3%, or 2.6%; or between 2.6% and 3% by weight.

In some embodiments, the food product provided herein has a free lipid content that is within a desired range as determined by an expert human sensory panel (e.g., has an aroma and/or taste that is determined by a expert human sensory panel to not be rancid; has a flavor profile that is determined by an expert human sensory panel to be desirable).

In some embodiments, the food product provided herein further comprises a carbohydrate. Non-limiting examples of carbohydrates include starches, flours, and edible fibers. Non-limiting examples of starches include maltodextrin, inulin, fructooligosaccharides, pectin, carboxymethyl cellulose, guar gum, corn starch, oat starch, potato starch, rice starch, pea starch, and wheat starch. Non-limiting examples of flours include but amaranth flour, oat flour, *quinoa* flour, rice flour, rye flour, sorghum flour, soy flour, wheat flour, and corn flour. Non-limiting examples of edible fibers include bamboo fiber, barley bran, carrot fiber, citrus fiber, corn bran, soluble dietary fiber, insoluble dietary fiber, oat bran, pea fiber, rice bran, head husks, soy fiber, soy polysaccharide, wheat bran, and wood pulp cellulose. In some embodiments, at least some of the carbohydrate is derived from plant. In some such embodiments, at least some of the carbohydrate is derived from pea.

In some embodiments, the food product provided herein further comprises a natural or artificial sweetening agent. Non-limiting examples of sweetening agents include *stevia*, aspartame, cyclamate, saccharin, sucralose, mogrosides, brazzein, curculin, erythritol, glycyrrhizin, inulin, isomalt, lacititol, mabinlin, malitritol, mannitol, miraculin, monatin, monelin, osladin, pentadin, sorbitol, thaumatin, xylitol, acesulfame potassium, advantame, alitame, aspartame-acesulfame, sodium cyclamate, dulcin, glucin, neohesperidin dihyrdochalcone, neotame, P-4000, and sweetening agents that do not comprise carbohydrates.

In some embodiments, the food product provided herein further comprises a mineral. Non-limiting examples of minerals include fat soluble minerals, water soluble minerals, calcium, phosphorous, potassium, sodium, citrate, chloride, phosphate, magnesium, potassium, zinc, iron, molybdenum, manganese, and copper.

In some embodiments, the food product provided herein further comprises an emulsifier. Non-limiting examples of emulsifiers include anionic emulsifiers, non-ionic emulsifiers, cationic emulsifiers, amphoteric emulsifiers, bioemulsifiers, steric emulsifiers, Pickering emulsifiers, glycolipids (e.g., trehalose lipids, sophorolipids, rhamnolipids, mannosylerythriol lipids), oligopeptides (e.g., gramicidin S, polymyxin), lipopeptides (e.g., surfactin), phospholipids, fatty acids, neutral lipids, polymeric biosurfactants, amphipathic polysaccharides, lipopolysaccharides, proteins (e.g., pea protein, soy protein, chickpea protein, algae protein, yeast protein, potato protein, lentil protein), mannoprotein, sodium phosphates, calcium stearoyl lactylate, mono- and diacetyl tartaric acid esters of monoglycerides, phospholipids, sorbitan monostearate, magnesium stearate, sodium/potassium/calcium salts of fatty acids, calcium stearoyl di lactate, poly-glycerol esters, sorbitan fatty acid esters, acetic acid esters of monoglycerides, lactic acid esters of monoglycerides, citric acid esters of monoglycerides, polyglycerol esters of fatty acids, polyglycerol polyricinoleate, propane-1,2-diol esters of fatty acids, sugar esters, sucrose esters of fatty acids, monoglycerides, acetylated monoglycerides, lactylated monoglycerides, diglycerides, phosphate monoglycerides, diacetyl tartaric acid esters, sodium/calcium stearoyl-2-lactylate, ammonium phosphatide, polysorbates, polysorbate-80, carboxymethylcellulose (CMC), modulated cellulose, citric acid esters, locust bean gum, guar gum, liposan, emulsan, lecithins, surfactants (e.g., sorbitan trioleate (Span 85), sorbitan tristearate (Span 65), sorbitan sesquioleate (Arlacel 83), glyceryl monostearate, sorbitan monooleate (Span 80), sorbitan monostearate (Span 60), sorbitan monopalmitate (Span 40), sorbitan monolaurate (Span 20), polyoxyethylene sorbitan tristearate (Tween 65), polyoxyethylene sorbitan trioleate (Tween 85), polyethylene glycol 400 monostearate, polysorbate 60 (Tween 60), polyoxyethylene monostearate, polysorbate 80 (Tween 80), polysorbate 40 (Tween 40), polysorbate 20 (Tween 20), PEG 20 tristearate, PEG 20 trioleate, PEG 20 monostearate, PEG 20 monooleate, PEG 20 monopalmitate, and PEG 20 monolaurate sorbitan), and derivatives and mixtures thereof.

In some embodiments, the food product provided herein further comprises an antioxidant. Non-limiting examples of antioxidants include natural antioxidants (e.g., α-tocopherol (e.g., tocopherol comprised in bovine milk); low molecular weight thiols (e.g., low molecular weight thiols comprised in bovine milk); retinol (e.g., retinol comprised in bovine milk); TBHQ; carotenoids (e.g., carotenoids comprised in cow milk); vitamin E; *Azadirachta indica* extract; riboflavin; rosemary extract; phenolic diterpenes (e.g., carnosol, carnosic acid) comprised in rosemary extract; sage extract; ascorbic acid and its salts; lactic acid and its salts; grape residue silage; phenolic compounds (e.g., ferulic acid) comprised in grape residue silage; soybean (*Glycine max*) extract; isoflavones or polyphenolic compounds comprised in soybean extract; garlic (*Allium sativum*) extract; sulfur, phenolic, flavonoid, or terpenoid compounds comprised in garlic extract; fennel (*Foeniculum vulgare* Mill.) extract; chamomile (*Matricaria recutita* L.) extract; brown algae (e.g., *Ascophyllum nodosum*, Fucus vesiculosus); essential oils of green pink pepper (GEO); essential oils of mature pink pepper (MEO); green tea extract; butylated hydroxyanisole (E320); butylated hydroxytoluene (E321); and catechins (e.g., epigallocatechin gallate, epicatechin gallate, epigallocatechin, C catechin, epicatechin, catechins comprised in green tea extract). In some embodiments, the food product provided herein comprises less than 2,000 ppm by weight of an antioxidant.

Food Product Properties

In some embodiments, the food product provided herein has a pH of between 2 and 10, 9.5, 9, 8.5, 8, 7.5, 7, 6.5, 6, 5.5, 5, 4.5, 4, 3.5, 3, or 2.5; between 2.5 and 10, 9.5, 9, 8.5, 8, 7.5, 7, 6.5, 6, 5.5, 5, 4.5, 4, 3.5, or 3; between 3 and 10, 9.5, 9, 8.5, 8, 7.5, 7, 6.5, 6, 5.5, 5, 4.5, 4, or 3.5; between 3.5 and 10, 9.5, 9, 8.5, 8, 7.5, 7, 6.5, 6, 5.5, 5, 4.5, or 4; between 4 and 10, 9.5, 9, 8.5, 8, 7.5, 7, 6.5, 6, 5.5, 5, or 4.5; between 4.5 and 10, 9.5, 9, 8.5, 8, 7.5, 7, 6.5, 6, 5.5, or 5; between 5 and 10, 9.5, 9, 8.5, 8, 7.5, 7, 6.5, 6, or 5.5; between 5.5 and 10, 9.5, 9, 8.5, 8, 7.5, 7, 6.5, or 6; between 6 and 10, 9.5, 9, 8.5, 8, 7.5, 7, or 6.5; between 6.5 and 10, 9.5, 9, 8.5, 8, 7.5, or 7; between 7 and 10, 9.5, 9, 8.5, 8, or 7.5; between 7.5 and 10, 9.5, 9, 8.5, or 8; between 8 and 10, 9.5, 9, or 8.5; between 8.5 and 10, 9.5, or 9; between 9 and 10, or 9.5; or between 9.5 and 10, wherein pH is measured in a solution of deionized water comprising a protein content of 4% by weight.

In some embodiments, the food product provided herein has a water activity of between 0.04 and 0.999, 0.9, 0.8, 0.7, 0.6, 0.5, 0.4, 0.3, 0.2, or 0.1; between 0.1 and 0.999, 0.9, 0.8, 0.7, 0.6, 0.5, 0.4, 0.3, or 0.2; between 0.2 and 0.999, 0.9, 0.8, 0.7, 0.6, 0.5, 0.4, or 0.3; between 0.3 and 0.999, 0.9, 0.8, 0.7, 0.6, 0.5, or 0.4; between 0.4 and 0.999, 0.9, 0.8, 0.7, 0.6, or 0.5; between 0.5 and 0.999, 0.9, 0.8, 0.7, or 0.6; between 0.6 and 0.999, 0.9, 0.8, or 0.7; between 0.7 and 0.999, 0.9, or 0.8; between 0.8 and 0.999, or 0.9; or between 0.9 and 0.999.

In some embodiments, the food product provided herein is a homogenized food product (i.e., a food product that has undergone homogenization) and comprises dispersed phase droplets having an average diameter of between 0.11 μm and 15 μm, 12 μm, 10 μm, 8 μm, 6 μm, 4 μm, 2 μm, 1 μm, or 0.5 μm; between 0.5 μm and 15 μm, 12 μm, 10 μm, 8 μm, 6 μm, 4 μm, 2 μm, or 1 μm; between 1 μm and 15 μm, 12 μm, 10 μm, 8 μm, 6 μm, 4 μm, or 2 μm; between 2 μm and 15 μm, 12 μm, 10 μm, 8 μm, 6 μm, or 4 μm; between 4 μm and 15 μm, 12 μm, 10 μm, 8 μm, or 6 μm; between 6 μm and 15 μm, 12 μm, 10 μm, or 8 μm; between 8 μm and 15 μm, 12 μm, or 10 μm; between 10 μm and 15 μm, or 12 μm; or between 12 μm and 15 μm.

In some embodiments, the food product provided herein is a coarse suspension food product (i.e., a food product that has been emulsified without the use of high pressure homogenization (e.g., in a colloidal mill, sonicator, rotor stator unit); e.g., a salad dressing, a mayonnaise) and dispersed phase droplets having an average diameter of between 1 μm and 10 μm, 9 μm, 8 μm, 7 μm, 6 μm, 5 μm, 4 μm, 3 μm, or 2 μm; between 2 μm and 10 μm, 9 μm, 8 μm, 7 μm, 6 μm, 5 μm, 4 μm, or 3 μm; between 3 μm and 10 μm, 9 μm, 8 μm, 7 μm, 6 μm, 5 μm, or 4 μm; between 4 μm and 10 μm, 9 μm, 8 μm, 7 μm, 6 μm, or 5 μm; between 5 μm and 10 μm, 9 μm, 8 μm, 7 μm, or 6 μm; between 6 μm and 10 μm, 9 μm, 8 μm, or 7 μm; between 7 μm and 10 μm, 9 μm, or 8 μm; between 8 μm and 10 μm, or 9 μm; or between 9 μm and 10 μm.

Food Product Preparation

A variety of recipes exist for preparing a food product, and any such recipe can be used in the method provided herein to produce a food product provided herein. The fermentation broth or preparation comprising the recombinant component can be used in such recipes in place of or in addition to conventionally used food ingredients.

It is to be understood that, while the invention has been described in conjunction with certain specific embodiments thereof, the foregoing description is intended to illustrate and not limit the scope of the invention. Other aspects, advantages, and modifications within the scope of the invention will be apparent to those skilled in the art to which the invention pertains.

EXAMPLES

The following examples are included to illustrate specific embodiments of the invention. The techniques disclosed in the examples represent techniques discovered by the inventors to function well in the practice of the invention; however, those of skill in the art should, in light of the present disclosure, appreciate that many changes can be made in the specific embodiments that are disclosed and still obtain a like or similar result without departing from the spirit and scope of the invention. Therefore, all matter set forth or shown in the examples is to be interpreted as illustrative and not in a limiting sense.

Example 1: Removal of Esterase Activity Via Purification

A recombinant *Trichoderma reesei* host cell capable of producing a recombinant β-lactoglobulin was generated by transforming protoplasts of a *Trichoderma reesei* strain with a polynucleotide targeted for genomic integration and encoding β-lactoglobulin under the control of an inducible promoter. Transformants were selected on a medium that comprised a marker that selected for integration of the recombinant polynucleotide.

The recombinant host cell was fermented in a culture medium suitable for growth of the recombinant host cell and for production and secretion of the recombinant β-lactoglobulin.

The fermentation broth was collected, and biomass and cell debris were removed by centrifugation to obtained a clarified fermentation broth. The recombinant β-lactoglobulin was isolated from the clarified fermentation broth based on charge (i.e., ionic complexation), thermolability/thermostability, and/or hydrophobicity.

For example, the recombinant β-lactoglobulin was isolated by separation based on charge (i.e., ionic complexation with a particle that carries an opposite charge as the recombinant β-lactoglobulin at a particular pH and/or ionic strength (e.g., a sodium acid salt), followed by isolation of the complex and elution of the recombinant β-lactoglobulin from the isolated complex via pH and/or ionic strength adjustment) followed by separation based on hydrophilicity (i.e., loading the recombinant β-lactoglobulin preparation on a phenyl sepharose column at suitable pH and/or ionic strength (e.g., 0.8M Na2SO4) to permit binding of esterase to the phenyl sepharose and collection of soluble β-lactoglobulin in the flow-through. The β-lactoglobulin preparation was optionally spray dried to obtain a β-lactoglobulin powder preparation.

In another example, the recombinant β-lactoglobulin was isolated by separation based on charge (i.e., ionic complexation with a particle that carries an opposite charge as the recombinant β-lactoglobulin at a particular pH and/or ionic strength (e.g., a sodium acid salt), followed by isolation of the complex and elution of the recombinant β-lactoglobulin from the isolated complex via pH and/or ionic strength adjustment) followed by separation based on thermolability/thermostability (i.e., heating (e.g., 80-85° C. for 20-60 minutes) at suitable pH and/or ionic strength (e.g., pH3 and conductivity <2 mS/cm, obtained, for example, by diafiltration) to precipitate out esterase activity, followed by removal of the precipitate via centrifugation to obtain soluble β-lactoglobulin. The β-lactoglobulin preparation was optionally spray dried to obtain a β-lactoglobulin powder preparation.

Esterase activities comprised in the β-lactoglobulin preparations were determined by adding the β-lactoglobulin powder preparation (at 3% w/w) to coconut and/or sunflower oil, and homogenizing at 200 bar to form an emulsion. The mixture was assayed for the presence of free fatty acids using a FFA kit (Product #KA1667; Abnova (Taipei City, Taiwan)).

As shown in FIGS. 1-4, the β-lactoglobulin preparations obtained by purification comprised essentially eliminated esterase activities.

Example 2: Removal of Esterase Activity Via Culturing

A recombinant *Trichoderma reesei* host cell capable of producing a recombinant β-lactoglobulin was generated by transforming protoplasts of a *Trichoderma reesei* strain with a polynucleotide targeted for genomic integration and encoding a β-lactoglobulin under the control of an inducible promoter. Transformants were selected on a medium that comprised a marker that selected for integration of the recombinant polynucleotide.

The recombinant host cell was fermented in three cultures that comprised a culture medium that was suitable for growth of the recombinant host cell and for production and secretion of the recombinant β-lactoglobulin. The three cultures differed from each other only in the type of antifoam agent comprised in the culture medium, which was selected from the list consisting of Industrol DF204, Polyglycol P-2000, and Erol DF6000K.

Fermentation broths were collected from each of the cultures, and biomass and cell debris were removed by centrifugation to obtain clarified fermentation broths. Esterase activities comprised in the clarified fermentation broths were determined by using the pNPL (product #61716; Sigma-Aldrich, St. Louis, MO) and 4MUo assays (product #75164; Sigma-Aldrich, St. Louis, MO) essentially per manufacturer's protocol. For the 4Muo assay, 20 uL of a clarified fermentation broth was combined with 20 uL 0.1M sodium acetate buffer pH4.3, and 40 uL 0.1 mM 4MU-o in a white 96-well plate, the mixture was incubated at 43° C. for 60 min before it was quenched with 80 uL 0.1M Borax solution pH9.22, and fluorescence was read by excitation at 365 nm and emission reading at 450 nm. For the pNPL assay, 40 uL of a clarified fermentation broth at pH4.3 was combined with 40 uL 1 mM pNPL solution in a 96-well PCR plate, the mixture was incubated at 43° C. for 60 min before it was quenched with an equal volume 0.1M Borax solution pH9.22, and fluorescence by emission reading at 400 nm.

Figure 5:
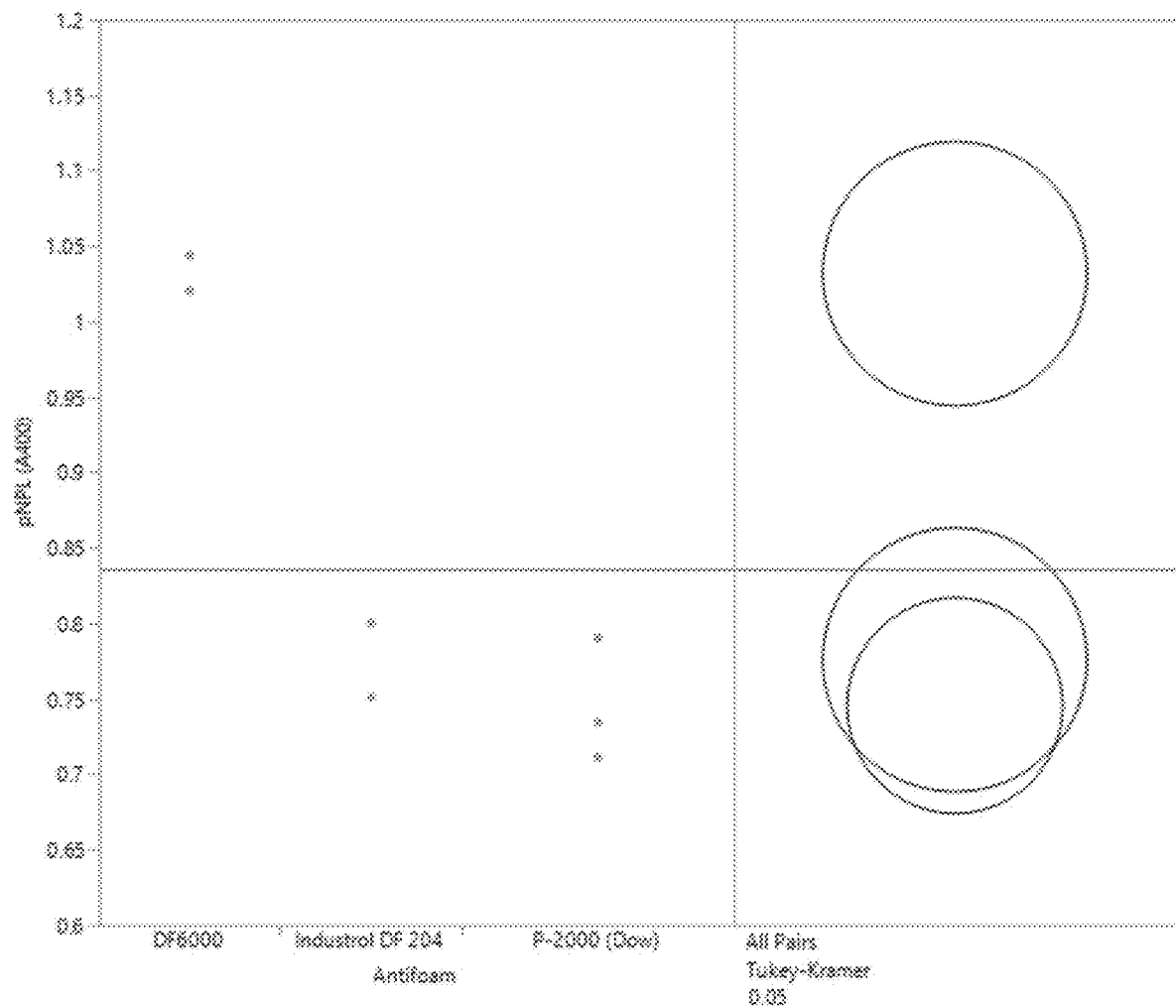
FIG. 5 is a diagram showing results of a pNPL assay of clarified fermentation broths obtained from cultures comprising the indicated anti-foam agents, with Tukey-Kramer analysis, in accordance with various representative embodiments of the present invention.

As shown in FIG. 5, a Tukey-Kramer analysis demonstrated that the clarified fermentation broths obtained from cultures that utilized as anti-foam agent Industrol DF204 or Polyglycol P-2000 produced significantly less esterase activity than the clarified fermentation broths obtained from the culture that utilized as anti-foam agent Erol DF6000K.

Example 3: Removal of Esterase Activity Via Genetic Modification

A recombinant *Trichoderma reesei* host cell capable of producing a recombinant β-lactoglobulin and comprising an essentially eliminated cutinase (e.g., cutI (UniProt #G0RH85)) activity ("cutinase knockout recombinant host cell") was generated by transforming protoplasts of a *Trichoderma reesei* strain capable of producing a recombinant β-lactoglobulin ("corresponding recombinant host cell") with a polynucleotide (targeting vector) engineered to integrate by homologous recombination at the cutinase gene locus and to replace the cutinase open reading frame with a selection marker.

Figure 6:
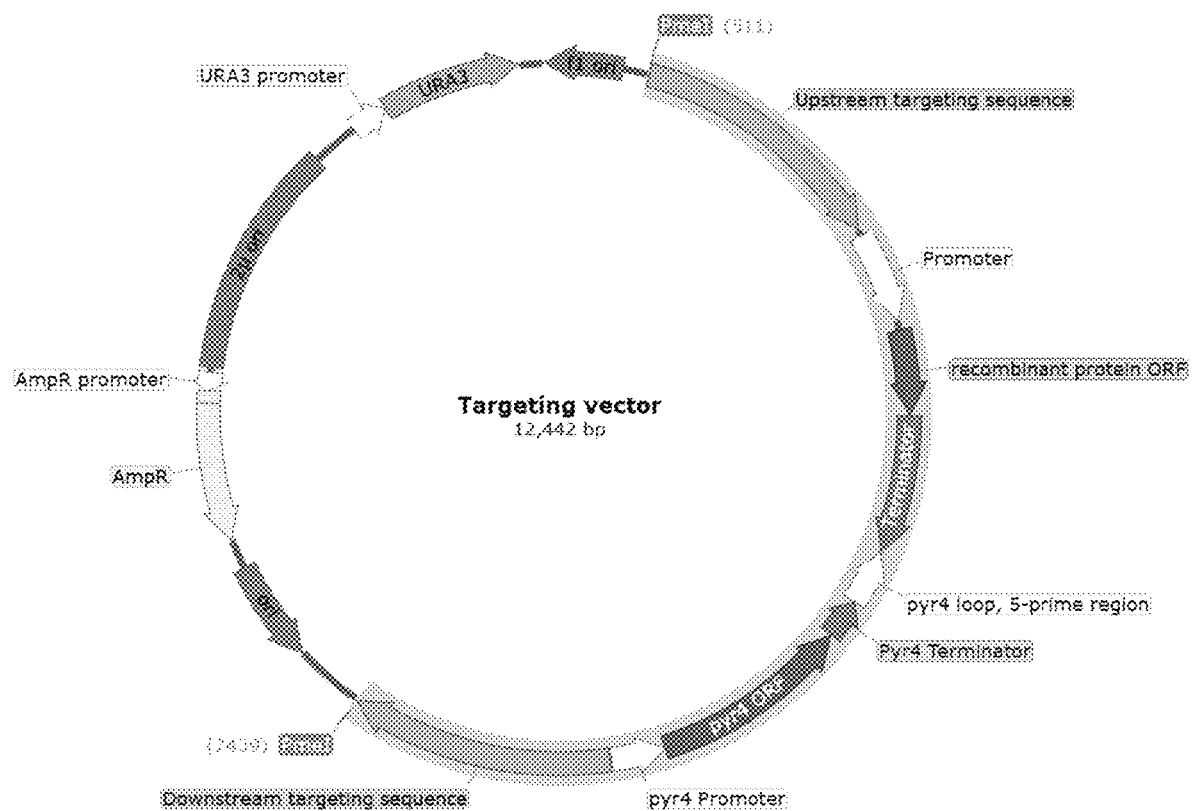
FIG. 6 is a map of a targeting vector used for production of a recombinant host cell comprising an eliminated cutinase activity, in accordance with a representative embodiment of the present invention.

The general structure of the targeting vector is shown in FIG. 6. The targeting vector comprised a selective marker (pyr4 gene, which enables growth without uracil supplementation) flanked by polynucleotide sequences that are homologous to the upstream and downstream polynucleotide sequences flanking the cutinase open reading frame in the *Trichoderma reesei* genome. The sequence of the upstream and downstream sequences are provided herein as SEQ ID No. 1 and SEQ ID No. 2, respectively.

Transformants were selected on minimal media, and then screened by PCR to identify a cutinase knockout recombinant host cell. The cutinase knockout recombinant host cell and the corresponding recombinant host cell were fermented in a culture medium suitable for growth of the recombinant host cells and for production and secretion of the recombinant β-lactoglobulin. Fermentation broths were collected, and biomass and cell debris were removed by centrifugation to obtain clarified fermentation broths. Recombinant β-lactoglobulin was isolated from the clarified fermentation broths based on charge (i.e., electrostatic interaction).

Cutinase activities in the β-lactoglobulin preparations obtained from the cutinase knockout strain and the parent strain were assayed using the FFA assay.

Figure 7:
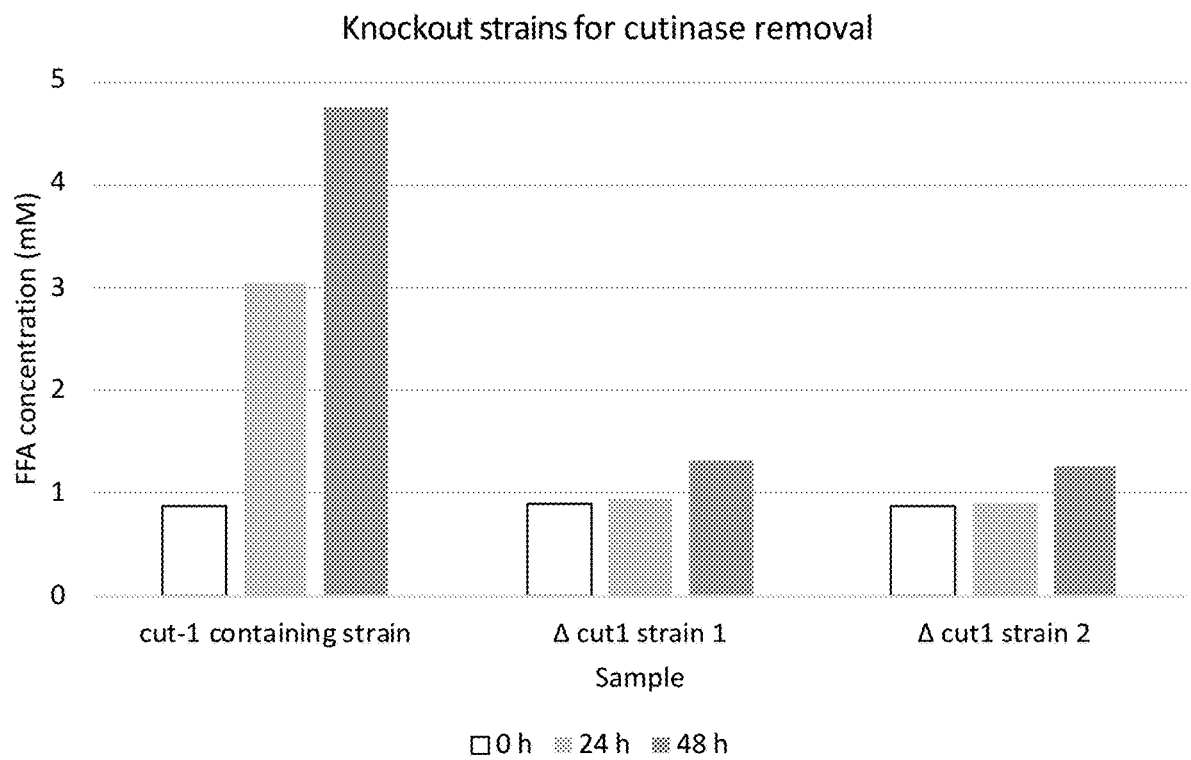
FIG. 7 is a chart showing results of a FFA assay for recombinant β-lactoglobulin preparations obtained from recombinant host cells comprising an eliminated cutinase activity in comparison to a recombinant β-lactoglobulin preparation obtained from a corresponding recombinant host cell, in accordance with various representative embodiments of the present invention.
Figure 8:
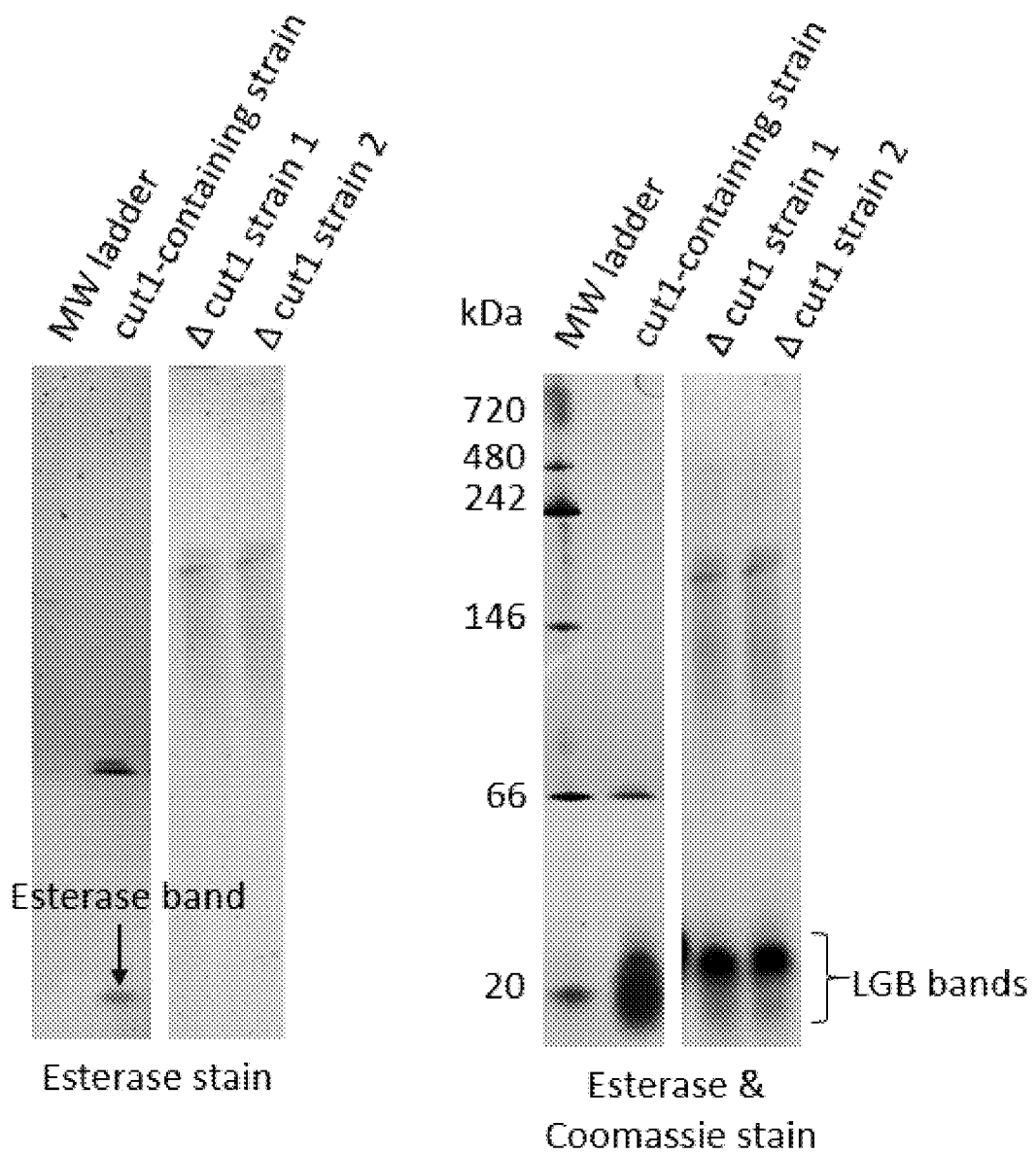
FIG. 8 shows stained native PAGE gels of recombinant β-lactoglobulin preparations obtained from recombinant host cells comprising an eliminated cutinase activity in comparison to a recombinant β-lactoglobulin preparation obtained from a corresponding recombinant host cell, in accordance with various representative embodiments of the present invention.

As shown in FIG. 7, in the FFA assay, the β-lactoglobulin preparation obtained from the corresponding recombinant host cell produced free fatty acids over time, which is indicative of the presence of a lipase activity in the β-lactoglobulin preparation. Such generation of free fatty acids (i.e., esterase activity) was essentially eliminated in the β-lactoglobulin preparation obtained from the cutinase knockout recombinant host cell.

Example 4: Ice Cream Composition Comprising Recombinant β-Lactoglobulin Produced in Filamentous Fungal Cell and Further Comprising Reduced Esterase Activity The following samples were prepared and incubated at 4° C. for 16 hours:

| Ingredients & Processing | Sample | | | | | |
|---|---|---|---|---|---|---|
| | A | B | C | D | E | F |
| β-lactoglobulin (1.45% w/w) | recombinant β-lactoglobulin (a) | recombinant β-lactoglobulin (a) | recombinant β-lactoglobulin (a) | bovine β-lactoglobulin (b) | bovine β-lactoglobulin (b) | recombinant β-lactoglobulin (d) |
| Ice cream ingredient mix comprising 11.7% mono/di/triglycerides | Yes | Yes | Yes | Yes | Yes | Yes |
| Heat treatment of β-lactoglobulin | None | 90° C., 10 min | 90° C., 10 min | None | None | None |
| 0.035% lipase (c) | None | None | Yes | None | Yes | None |

(a) Produced by *Trichoderma reseii* host cell comprising a heterologous polynucleotide encoding bovine β-lactoglobulin.
(b) 95% pure protein isolated from a commercially available whey protein isolate derived from sweet whey.
(c) Recombinant triacylglycerol lipase produced by *Candida cylindracea* (Lipase AY 30SD-K, Amano Enzyme).
(d) Comprising an essentially eliminated esterase activity produced by purification as described in Example 1, culturing as described in Example 2, or genetic modification as described in Example 3.

Figure 9A:

As shown in FIG. 9A, use of recombinant β-lactoglobulin produced by a filamentous fungal cell led to formation of an undesired gel composition. Moreover, the preparation developed a rancid aroma and taste.

Figure 9B:
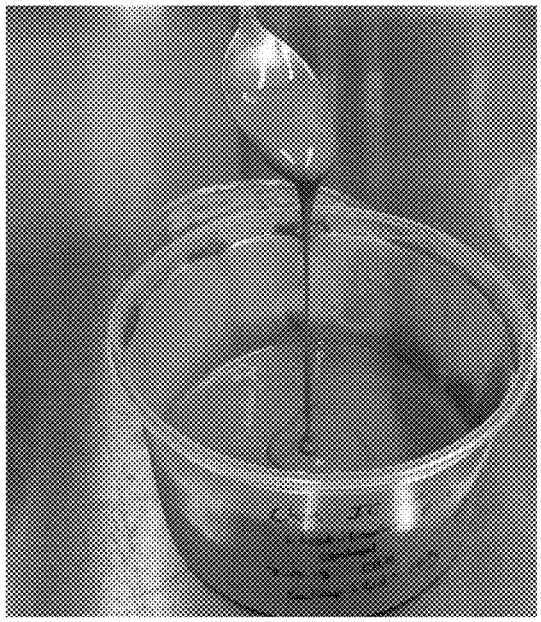

As shown in FIG. 9B, heat-treatment of the recombinant β-lactoglobulin prevented gelling (and reduced development of rancid aroma and taste).

Figure 9C:

As shown in FIG. 9C, addition of triacylglycerol lipase negated the effect of heat-treatment of the recombinant β-lactoglobulin in that the preparation again formed a gel composition (with rancid aroma and taste).

Figure 9D:
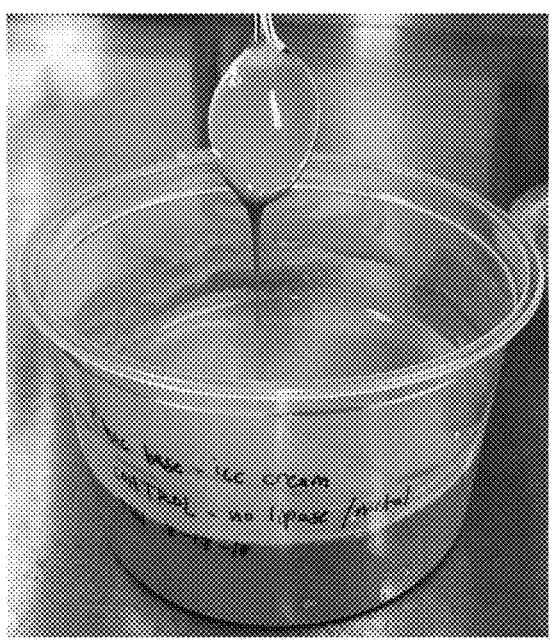

As shown in FIG. 9D, the use of bovine β-lactoglobulin purified from whey did not provide the undesired gel composition. It also did not produce the rancid aroma and taste.

As shown in FIG. 9E, addition of triacylglycerol lipase to bovine β-lactoglobulin lead to gel formation (and rancid aroma and taste production).

As shown in FIG. 9F, use of a recombinant β-lactoglobulin preparation comprising an essentially eliminated esterase activity provided a desirable ice cream texture with desirable aroma and taste.

Taken together, the data suggest that a preparation of recombinant β-lactoglobulin produced by a filamentous fungal cell can comprise activity of an esterase that has a detrimental effect on texture, aroma, and taste of a food composition.

Example 5: Identification of Esterase Activities that Provide Desirable Sensory Profiles Additional recombinant host cells (e.g., additional recombinant *Trichoderma reesei* host cells, additional recombinant

*Aspergillus niger* host cells, additional recombinant *Trichoderma citrinoviride* host cells, additional recombinant *Myceliophthora thermophila* host cells) capable of producing a recombinant component (e.g., a recombinant milk protein) are produced as described in Example 3 by targeting other esterases (e.g., carboxylic ester hydrolase (e.g., UniProt #G0RBM4, G0RIU1), phospholipase C (e.g., UniProt #G0REM9), acetylesterase (e.g., UniProt #G0RHJ4), and transcription factor that regulates expression of an esterase (e.g., UniProt #G0RX49), and any other esterase disclosed herein, combinations of two or more such other esterases, and combinations of one or more such other esterases with cutinase (e.g., UniProt #G0RH85), using similar targeting vectors as the one disclosed in Example 3 but comprising upstream and downstream targeting sequences specific to the targeted esterase loci, or using other mutagenesis schemes to introduce mutations (e.g., changes, deletions, or insertions of one or more nucleotides) into nucleotide sequences that regulate expression of esterases or into open reading frames encoding esterases to produce recombinant host cells comprising modulated (i.e., higher or lower) or essentially eliminated esterase activities. Recombinant component preparations are obtained from such recombinant host cells according to methods described herein, and used to prepare food products. The food products are tested for a desired sensory property (e.g., a desired odor, a desired taste, a desired texture, a desired emulsification) to identify a suitable esterase activity or combination of esterase activities that provides a desirable sensory profile for that food product. A suitable esterase activity or combination of esterase activities that provides a desirable sensory profile for a particular food product can depend on the specific composition of the food product (e.g., the specific lipid profile of the food product).

All publications, patents, patent applications, sequences, database entries, and other references mentioned herein are incorporated by reference to the same extent as if each individual publication, patent, patent application, sequence, database entry, or other reference was specifically and individually indicated to be incorporated by reference. In case of conflict, the present specification, including definitions, will control. The terminology and description used herein is for the purpose of describing particular embodiments only and is not intended to limit the scope of the invention.

SEQUENCE LISTING (231 sequences)

SEQ ID NO: 1 - DNA, 1510 bp, trichoderma reesei
ctagccagaaggacgcataaacggaagaaaccccacgaggtcccatgacttctccagaggccgatctgccggcccgttacccatctgggcatcaagcggataatgccaatgcatcgtttttgacaggaaaagcggttggtttgcggggtattcgacagccgagctgggggaagcagaaaggaagcgcgggatggaagcgaagaggagcggctttgttgctcttttcatgcgagctgtgcgtcaactacagactacagcaggacaggtgccacaatgacgccgtacaactgtccggactcgggctcgagactcttttccatcacataatatctccatgagctgaatcgtggctgaggaggagagtttgacgcggcatgtttctacgttccccccggctagcctgtacttacacacacacactcaaagcctgagggtgttcacggaccgcatatgccgtctaagcgcacacaccttctcggcttcttccttggcttcactctggtcttttttctttggcttgtgatgccgagaatctcgtttgtcgttttgatttgagggcgatgagagggagctgagtcgcgatgccctgcgataaatcttttgtattcgagtgtgcgagtctataatgttgtacgccggccaatcaactatagcgagccgcgtggcgatcatgacccttgtttgaagtggacagaactagaagctggctggcaagggggattgtcgagatgtcgtcgcttcagaactgtcagtgctcgagcttgaagatttgactcaataccaacgagtcagttcatacaatcaggaaccaatgcggatacagagacagaatctgactatcatcgccactttcatcgtcccagagctccagagccaacaaacagcatatgacagcggaactttccccccctcaaccccagattaaatgctccgttctgcatagtcagtcacacgcattggcctctgggcccccgtcattggcaccgtctcactggcggatcgccgaggcgccgcatcgcaaaggggagaaaagacggcactccagtccggatctggaaggttgtttcttgtgatgcggaggaagcgtggcccgagagggtgttgcaggatgagcgttgactcgtcaattgggccttgaggggctgaggatggagacaatactagatctgttgtctgctgcgggcctggttgatatcgtggggaaagcgtgtgctgcgtaaaggaagcattcgtcaggtcaggacaggtgaggagtatataaagagtctggattgactccgagttctacttcctctcggccattctctggtgtctcttggagcaaaagcagcccttcagcctctcagcatcttcactcgcaaaaaaacccacttacaagatgcggtccttggccattctcaccaccctcctcgcaggccatgcctttgcataccccaagccagccccccagtcagtcaatcgcagggactggccttcgatcaacgagttcctctctgagttggccaaggtg

SEQ ID NO: 2 - DNA, 1503 bp, trichoderma reesei
gtcttggagagggttacggaagaggttgtgagagtcaaagtatggagaatgggcgaacataaaaaaaagggatcaatgattgtatatagcgaaagccactgaacatattgtatataagcaagcgttatgagatacatcaatcatgttttgacatatttctctgccaatagtgtacaatgtgtagacttaagcaaactcgaatcaattcatcgctcatctacaagaaacatacaagattgtttctcatgtgtctttataaagacagtgaccgtccacctctcaagtccgataacttatgcatcatcaaagtttcttacttgcggccgataagctcaaggtagtgttcaacaacagagactgtcatctcttcaaaagacttgaacttaaagccaaactccttctcagcctttgtcgaatcgatatgcaccgggatcgaaacaggccggggaacggactcgaacttaaagatgccgtcggcataagcctccgggaagtgcctcttcacaatctcaaaagtctcagcccagtcgatggattcagtgggatgagcacaagcgagatagtcctggttccccttgacgttcggccccagggcaaggacatgcatctttgcaacatcgtcgacgtggacggcgacgccgggaagaggatcacggggcacgcccaggagagggtccatgatgatgccgttggtgcccttggagatgttggcggggtcggtgacggtgtcgtcgcggccgatgacgaagacggggaggatgttgacgacggagaaggcgggcttcttctcggcgatgaacttttccgtggcctggaaggcgagggctttggaggcgacataggcggcgatgctggaggcaaaggggccttccgtgttggaggcacgggtttgttctgttgacgagcggtaagtcagaattgacccctatttctggaggcataacaggaagaggaaggaggatttagctagctgcatatgctgggaagaaagacataccgttgaccttgactcccgaggccagggcctcgaaagaggcaatggaaaggacagatgcggtgatgacaatcttttcgatcccagagaccttgattgcagactccaggatgccaaccgtgccctggacggcgggccggatgatctcagcctggcatgcctcatcaccttcgaccgtcggggaggctaggggtgaagcaacgtgaacgacatatttgacgcccttgacagcttcatcgtaggcacctggaacaatgatgttggggacaatgatgctctcgacttgtgagaggtaaggcgcaagaggcttgaggctcgagatgcgttcgaagccggcctgggtacggacggcggcgcggacattgtagccagccttgacgagttcgacgagggtcctgaagccaatcatgccagtggcaccagtgagctaaataggggacgtggttgttagttggcgagggatcgggtggagcatttgtgtgtatatccgtgttgctccggctcaagac

SEQ ID NO: 3 - protein, 924 aa, Trichoderma Reesei
  ref <308>: DATABASE ACCESSION NUMBER: UniProt G0RX49
  ref <309>: DATABASE ENTRY DATE: 2019-10-19
  ref <313>: RELEVANT RESIDUES IN SEQ ID NO: (1)..(924)
MDGEVPSGDGSSRVSPPQQQQQQQQQSQSQSQPPAQSKTSPSSSAAASAANQMSFRRQRASRACETCHARKVRCDAASLGVPCTNCVAFQIECRIPTPKRKKTQAAGSQANKDSDSDRGDNTDEPSRQTQTPHSSTATPYSPRASAPTVSHTTDGTPPTSLTEAQARKEEVDNGTYLNLVMKPKFTRAPITEAGRVAYLGESSNLTLLVHDRQGSADVVHYPLPENVRGSRARLTELDNVEIDILHQRGAFLLPPRSLCDELIDAYFQWVHPIVPVINRTRFMRQYRDPKNPPSLLLLQAVLLAGSRVCQNAQLMDANGSTTPAALTFYKRAKALYDANYEDDRVTIVQSLLLMGWYWEGPEDVTKNVFYWSRVATIVAQGSGMHRSVERSQLSKSDKRLWKRIWWTLFTRDRSVAVALGRPVHINLDDSDVEMLTEDDFIEDESDRPSEYPPDPIHVQFFLQYVKLCEIMGLVLSQQYSVASKGRQRNAIDLTHSDMALADWLQNCPKIVYWEMPRHHFWSALLHSNYYTTLCLLHRAHMPPSGSPRFPNDTPYPSRNIAFQAAAMITSIVENLAAHNQLRYCPAFIVYSLFSALIMHVYQMRSPVPSIQQVTQDRLRSCMQAMKEVSRVWLVGKMVYTLFESILGNKVLEERLQKAGGKRHRKMQQTVAQLEQLNNRHETAKRKYDDMAMDFMSNTPTPQESYERSRPQTPSATRNDSTANPGQRSSAASPTVRHGGADTFMGGTSSRPHTRPATPFNPSFSLPATPPDLYLVTRNSPNISQALWENFQPDQLFPESSSLSAFPNLSPTQTHQTLDQNAMNQVPGSGGMAAGMQANQYRGSGQNAAQGAAGMVPMSGFQGQQSSLWQSGFDGGLQDSNSPDSWGTSSAQGQPAPTTLNVEDWFQFFGINGDMSSINLDMPLG

SEQ ID NO: 4 - protein, 621 aa, trichoderma reesei
  ref <308>: DATABASE ACCESSION NUMBER: UniProt G0RWS1
  ref <309>: DATABASE ENTRY DATE: 2011-10-19
  ref <313>: RELEVANT RESIDUES IN SEQ ID NO: (1)..(621)
MTSVASYPPGTQASPLDQRAAPVAPDGYTPARVSCPANRPTIRAATGLSRNETDWLPLRTNNTVEALKDVLSRANISGLDTGRYIDNLTNVGTGLPRVAIAISGGGYRALMNGAGALAAFDNRSTNATEAGHLGGLLQSATYLSGLSGGSWLVGSLYVQNFTSVESISLATDGFLSTLWQFDNSIINGPSGQSVISYYRQLFDDVDGKSNAGFNTTITDYWGRALSYQLVDPSDGGPAFTFSSISNDSDFVNAQAPMPLIVAIERTSGQLQIASNSTIFEFNPWEMGSYDPGLEAFAPLQFVGSNFTNGSIPRDGECIAGVDNAGFVMGTSSSLFNQAFLQIGRVEGVPEFLIRAINESLANVGSENRDIANWPNPFFGYNASVNVNANTTVLALVDGGEDLQNIPLHPLLLAEREVDVVFAVDGSADTETLWPNGTSMVATFNRSEARVSSNDSRFPDVPDQNTFVNLGLNQRPTFFGCSNGSNTPSGPLIVYMPNAPYSFHSNVSTFDLEYSDAERNQIIQNGYNMATMGNGTVDPNWPTCVGCAILSRSLIRTRTAVPAKCRDCFARYCWNGTTNDSLPNTYEPAQILEGSTQQADSSSAARLGGTLLLAVVALMVAL

SEQ ID NO: 5 - protein, 800 aa, trichoderma reesei
  ref <308>: DATABASE ACCESSION NUMBER: UniProt G0RKL4
  ref <309>: DATABASE ENTRY DATE: 2011-10-19
  ref <313>: RELEVANT RESIDUES IN SEQ ID NO: (1)..(800)
MADFLLRPPTILPIQGSNSSTQFPKRPKHVSTASQPADQTLVHTVAQKVKEAASLWRSWKDGVSVEDREKARLLEERKNLLYLRMKSAETLKQWQAAAQELDALEGNDDWKLDDESGDYNPKLIEERLQALNEARESRDIRTMMHLIRTSLSRDLGGMGNVDLYRHSYLGTKSLIERYVEATIETIDAAIVHSASDKGIAYRDLLEGMLLARQSFGRSALLLSGGGTFGMAHVGVLKALFEAQLLPRIISGASAGSIVCAVMCTRTDEEIPQLLKEFPYGDLAVFEAQDSQDGLLDHFRRLLTEGSWSDIAHLRRVMRSMMGDITFQEAYNRTRRILNICVSSASVYELPRLLNYVTSPNVMIWSAVAASCSVPLIFGSSPLLVKDPVTGEHRQWNPSPQRFIDGSVDNDLPMTRLAEMFNVNHFIVSQVNPHVTPFLSKDDHLSPENQRARKSANNGDDMDWLYTCTSLARDEALHRLQFMAEMGFFPNMMTKFRSILSQKYSGNINILPDLSLDNLPVLLRNPTVDFMLKCCLVGERATWPKLSRIRDSCAIELALDRAVHRLRTRVVFSESQSNLRSITSHKSSLRLNPHGQTAAQQHLGVLGASQGQKRQRRRSGGSLLMLPGTGLALDRELTDEDSAEEERLEIASRRPGFASSTSLRKPQLKRSSMSQTHVPQLSSQAQQMPAFNFSKPLTPPSSVSGEADATDATRTSNSEATLPAASVSDKAARVLPTLGHVISPVDEVETSEPNHTSETEVDQGTDESDPDDSRSILAEDTAKPADHGALRPAIHVTGGSW

SEQ ID NO: 6 - protein, 514 aa, Aspergillus niger
  ref <308>: DATABASE ACCESSION NUMBER: A2QLA0
  ref <309>: DATABASE ENTRY DATE: 2007-03-06
  ref <313>: RELEVANT RESIDUES IN SEQ ID NO: (1)..(514)
MILSTLLLLLPTLTAASDDHLTVRTRTGKFTGLLNPDFPSVREFRSIPYAQPPVASRRWLPPAPLADSNETHYATNYPPSCAQYVSGNPSVFGSIVPEFYIWDGNENSTAGLMAQASSEDCLQLAIWAPTNATNLPVIVFFTGGAFKTGGINIPYQLPPSWVSRTQSHIVVTTNYRVNIMGFPNAAGLDNQNLGILDQRAALEWVRENIHNFGGDPEAITLWGQSAGSISTDFHTYAWHDDLIARATISQSGTALKPLDNYDHDHTNFTFVAKHMGCDFPTNPTAELDCMRQVSVNRIQNFVGQYIDNKTTPSLTFTPIADEKVVFSDYPARAAKGLIANTPAIMSNCANEAAALYTFPTNNVTAGPWQPGVNAATLDGWLCVSANTSIVRYNANRTTYRYQFAGNFSNVSPMHWLGAYHSSDLTMNFGTYPIVRGNGTLLEKKTSEVMQDYLLAFMRDPETGLKRMGWPAFEPFGENGGVIKRFGADGRPEQNVTGLEVQGACWGKEQYDPFP

SEQ ID NO: 7 - protein, 626 aa, trichoderma reesei
  ref <308>: DATABASE ACCESSION NUMBER: UniProt G0RBZ6
  ref <309>: DATABASE ENTRY DATE: 2011-10-19
  ref <313>: RELEVANT RESIDUES IN SEQ ID NO: (1)..(626)
MADRLTSRLAGLNPFKPTAAAADDDDKGDLIAPEPGHLSRKSDHGKAQLRVSHALRSFLVHQGILSERDAGLDSSYSSSDFSSPEPLRALLGRRSFEAPAPLLDPKHALPEYFVSSSHNTYLLAHQLYGKSSAAAYETALTTGSRCIEIDAWDDPECADEPKVTHGYTLVSHIPFRAVCETIRDVFDREQQQQQQQAGDAAGVSASAAASPILLSLENHCGPHGQRRLVQIMRDVFGHRLISEPVRAKGTREQQGSGEHVTLADLGSRIAVIVEFHLPDEASSSSSSSSSSSSSSSSSSSDDNDDNDDNDDDKNDKEQQRQARRAYKASKKKQSSTAIVPELAQLGVYAQSVKPKDNSWFDPGQLVDGPHHHLINVSESGLAAHLPQHAVAIARHNARHLMRVFPKGTRISSSNLRPVRFWAVGAQICALNWQTFGTSNQLNDALFSGSAGYVLKPAALREGGSGSLATGRRRRLRVHVAGATDVPLHDADRERDSIKPYLTCTLYSPLAAADNDDANSNGEGEPAKRKTAPYRHHKLGFLHRGENPHATDPVWDETLEWEYEDNELVFLRMLIKSDDSFARNPKFAAVAVRLAYAEPGWTFLRMMDLKGKETDCTLLVKFDFEDL

SEQ ID NO: 8 - protein, 533 aa, trichoderma reesei
  ref <308>: DATABASE ACCESSION NUMBER: UniProt G0RIU1
  ref <309>: DATABASE ENTRY DATE: 2011-10-19
  ref <313>: RELEVANT RESIDUES IN SEQ ID NO: (1)..(533)
MLAQSLLVPALLLSVVGAVQDTVDVGYSIYKGQALPNGVSQWLGIRYAAPPLGELRFAPPQEPLRTPGVQDATIHGKYCLGTGRSPTDKSTSEDCLFLDVQAPTKATVHSKLPVFLYIQGGGFNLNSNPNTNASGLIINSGYDIVVVSLNYRVGPYGFMTDSDKIVPNNGLRDQRKVLEWVQKHISQFGGDPNHITLGGSSAGAASVTYHLTANNGTNRGLFHAAIAESPSFATTLSVAQSQYMYTQFATRVGCVGKDSLACMRKKTAVELQTSNFNIPLPGASKPPNYMWLPTLDNEFVQDYTYRVFQQGKFIRVPTVYGDDSNGGTKFAPKDTATLQESNGYVLDQYPVLTLEMLGEINELYPNPNTSCPAVGCYWRHASNVYQEARYMCPGMYISSVVAKHGKDAWVYRWNVEDPEQMASGLGVPHTVELNALWGADYVDDAPASYQDGQVNAAASPTMQHYWLNFIKYYDPNGRNAYDGSRYPQWKKWGEGAQSRLTFQTGGKAEMIPVDSGLRQRCDFWTRNGVALTM

SEQ ID NO: 9 - protein, 633 aa, trichoderma reesei
  ref <308>: DATABASE ACCESSION NUMBER: UniProt G0RHG1
  ref <309>: DATABASE ENTRY DATE: 2011-10-19
  ref <313>: RELEVANT RESIDUES IN SEQ ID NO: (1)..(633)
MLDEPEGETAPKDGPRDLLEEFAIESHCLDAPMSMEDLELLRADIESDKSPRDSLSDMVDTFNLPNYVRPLTSLPPDDMEFLHAEGALTLPDSALQNALLRAFFEYVHPYVPTLDLDAFLHSIETPDGSAGQVSLLLLQAVLAAGTAHVELHHLRNAGYQTRKQARTAFLKRVRLLYKYNCELDQMVLTQSLLLITSWQDASDEHGKTWFWIDAAVSHAFAAGLHLEPSVNKPNLSRRKQRLRRRVWWCCFIRDRLLSLGMKRPPRIKDGDFQVAMLDEADFQPEQIRSDDGDHARFEAVCVYVRSRKKRAELARMCVAQATLCRSMSFLSSSMYVAPHDSLAVPSSSSQEAGATRARPRADDGGEQKLFTTYIRDLLEWRDGLPEGVSYRPISSSDIGRDGNTSISLDRAVLHMIYYAAVLCLYRSRFVALLQQQQQQQQHGAGDSSSSSWSMEKELCKTYMQHSAKRIGDIARNIYDHGLDRLLPSMAANIAVSAASVHLLELRGQLQGCGTEPSYRQSRRLMQSMHDIYAGADLSRESLKWHEEEEQQQQQERREKEEKGMSWSSPGGEVAAETGGKEEKEEEDYLVADADWLKDLEAATCWYVAEPYRADSFLQYPGEGLDVVNEFFAF

SEQ ID NO: 10 - protein, 638 aa, Aspergillus niger
  ref <308>: DATABASE ACCESSION NUMBER: UniProt A2QT90
  ref <309>: DATABASE ENTRY DATE: 2007-03-06
  ref <313>: RELEVANT RESIDUES IN SEQ ID NO: (1)..(638)
MKLPLFAAAAAGLANAASLPVERAEAEVASVAADLIVRALPNAPDGYTPSNVTCPSTRPSIRDASGISTNETEWLKVRRNATLTPMKNLLSRLNLTGFDTTSYINEHSSNISNIPNIAIAASGGGYRALTNGAGALKAFDSRSDNATNSGQLGGLLQAATYVSGLSGGSWLVGSMFVNNFSSIGELQASEKVWRFDKSLLEGPNFDHIQIVSTVEYWKDITEEVDGKANAGFNTSFTDYWGRALSYQLVNASDDKGGPDYTWSSIALMDDFKNGQYPMPIVVADGRNPGEIIVETNATVYEVNPWEFGSFDPSVYAFAPLQYLGSRFENGSIPDNGTCVSGFDNAGFIMGSSSTLFNQFLLQINSTSIPTILKDAFTDILEDLGERNDDIAVYSPNPFSGYRDSSEDYATAKDLDVVDGGEDGENIPLHPLIQPERAVDVIFAIDSSADTDYYWPNGTSLVATYERSLEPSIANGTAFPAVPDQNTFVNLGLNSRPTFFGCDPKNISGTAPLVIYLPNSPYTYDSNFSTFKLTYSDEERDSVITNGWNVVTRGNGTVDDNFPSCVACAILQRSTYRTNTSLPDICTTCFNDYCWNGTTNSTTPGAYEPSVLIATSGAIKSVLDYSVLALAMGVAAFML

SEQ ID NO: 11 - protein, 768 aa, trichoderma reesei
  ref <308>: DATABASE ACCESSION NUMBER: UniProt G0RJ76
  ref <309>: DATABASE ENTRY DATE: 2011-10-19
  ref <313>: RELEVANT RESIDUES IN SEQ ID NO: (1)..(768)
MSDDKATKPYPQLAPYDASYGFSRDLFDPSALPNIDCEYLDSEDLNAFETALQAPDPLQSPIDDTSSLKSPRSVSSVNLTKRDSQAGSVLEEDVAAVAAAAGAAGGDLPVPPTPSMGTFVTAQNDWAPVNPGKYRSKRGAKKKKKGRGAVEGLLGTRTKDETREGYLYLLSKWPLLFFVFSWLIGLSIAYLSTRWYIWFYEHFFTWRGRREILRKNMRRTSSYNGWVAAAKELDDYLGRKSWREVDDFAYYDSKTVKRVWTQIRKTRLKAESLELEGDRQELKKAVDDLRALMEACVKNNFVGVENPKLYSQTYYGTKNLVQNFVDDVEKSLRFLLKTEHLEADEKRILFKHIHANYGRTALCLSGGATFAYYHIGVVKAMLDADLLPDVITGTSGGALIAGLVATHTNDELKQLLIPALAHRITACGESMTTWFPRWWKTGARFDSVDWAKRCSWFTRGSMTFREAYERTGRILNVSCVPADPHSPTILCNYLTSPDCVIWSAVLASAAVPGILNPVVLMMKMRDGTLAPYSFGHKWKDGSLRTDIPIKALNTHFNVNFTVVSQVNPHINLFFFSSRGTVGHPVTHRKGRGWRGGYLMSAIEHYLKLDMNKWLKFIRHAELLPRPLGQDWSQLWLQDFGGTITIWPKSIPSDYWHILTDPDADRLARMIHEGQQSTFPKLKFLSNRLKIERLIEQGRRETRPWARRGSMQRIYSDDDLRSILLEEMAVTSSAASATEEDSELDGETMTTEIGATPSQDGDEKDEARM

SEQ ID NO: 12 - protein, 580 aa, Aspergillus niger
  ref <308>: DATABASE ACCESSION NUMBER: UniProt A2QZX4
  ref <309>: DATABASE ENTRY DATE: 2007-03-06
  ref <313>: RELEVANT RESIDUES IN SEQ ID NO: (1)..(580)
MFVSSLALLALIAPLIAIAVKIEQPGINPNPTATVRNGTYYGLHNQHYNQDLFLGIPYAQQPIGDLRLRTPRSMNTSWPVPRNATEYSPACVGFNQTEGASEACLTLNVVRPASIALSESLPVAVWIHGGGFTSGSSSEKQYNLSFIVDQSVQMEKPVIAVSLNYRLQCWGFMWSKEMKEAGVGNLGLRDQRLALHWIQENIAAFGGDPAQVTIWGESAGANSVGTHLVAYGGRDDGIFRAAISESGAPSVYQRYPTPAEWQPYYDGIVNASGCSSATDTLACLRTIPTNILHGIFDNTSIVPMHAISGLSGAKFIPVIDDDFIKESATVQLQKGNFVKVPYLIGANADEGTAFAVEGVNTDAEFRELVKGWGLNNATTDILEALYPDIPQIGIPAIMVGRPPSGYGNQYKRVAAFQGDVNIHAARRLTSQIWSSRNISVYSYMFDVISPGYGPSAGSYAGATHGTDIPYVFYNLDGLGYDSNNKSIESIPNSYSRMSKIMSRMWVSFVTTLDPNHSGGMVPHPIPMIAQCQTRAESTIFLGTNVQWPPYNIDNPEIIFFDTDVTNLTYTWPAGLYAHWW

SEQ ID NO: 13 - protein, 665 aa, trichoderma reesei
  ref <308>: DATABASE ACCESSION NUMBER: UniProt G0RJC6
  ref <309>: DATABASE ENTRY DATE: 2011-10-19
  ref <313>: RELEVANT RESIDUES IN SEQ ID NO: (1)..(665)
MASDQDQPANASLQSGGGSIPAQRSLQSLSTTTLAYLKRLFDSHATPEGKWTPEQIRVFIQKVQGGSNSSSGSSDVVEEELNLDGFLAYMTSPHSSAILPVLNEDLSWPLASYFISSSHNTYLTGNQLSSDSTTGAYTNVLLRGCRCVEIDVWDGDESDAESSSSSDSSSSSSESETSDDEAAAKKAALKEKKKKEKKEKKDKKAGWSEQLRSKMDKINISKKVDKMQEKATEKVAELQEAMTSSSKTDSAAVEPRVLHGYTLTKDIRFRDVCEAIRESAFVASEMPLIVSLEVHCSPQQQLIMVDIMKQVWDGLLVTDPESAIESLPSPEELRRKILIKVKYVPPGTPLDKVDTVSSEQQQQQVSAGGGGGGDGTPPKKPAKTIQELARMAIYTQGVTFKGWTQPEASMPTHIFSISEKKFIDYHEKQWATLFNHNKHYLLRAYPAGLRIGSSNLNPAIFWGGGAQIVALNWQETDEGMMLNEGMFTGTGGYVLKPEGYRSKLTLKEDTSTPSPITIARKTVSLAFTFLSAQNLPLPPDEKSAKGFKPYVKVELHVEASKNSHAESDGHVHESEYKVRTKTHKGCDLDLAGERLEFKAIPGLVEELTFVRFTVRDDEFGRDDLAAWACVKLDRLGQGYRFVHLRNTKGEATDGAILVKVEKSVV

SEQ ID NO: 14 - protein, 299 aa, Aspergillus niger
  ref <308>: DATABASE ACCESSION NUMBER: UniProt A2R6L8
  ref <309>: DATABASE ENTRY DATE: 2007-03-06
  ref <313>: RELEVANT RESIDUES IN SEQ ID NO: (1)..(299)
MAELVPDNAWDTHIHVFDPKKFPYAVPRSYTPQAAQMAEYPTVITGCKNIVIVHASIQGVSPAPLVDTLSKQQEMPGYTLRGLATIDPFTVTDEQLDALHAAGVRGARLHEMAWGHGKQSGGNDIIKKVEALAHRLARLGWAIGIFCPVSAWAAMADTIRNMDPRIQMVADHFGGTFPGEEYSAEFATFLDLIREKRVWVKVSGFERLYHGHESGMKAIEPIAKAVIQAGPDRIIFGTDWPHTQLGVTRKGKTDQQRLEEVEGFREVDDAGHIRTLREWIPDEETWQNLWVNNPAKLFQ

SEQ ID NO: 15 - protein, 953 aa, Aspergillus niger
  ref <308>: DATABASE ACCESSION NUMBER: UniProt A2R2J1
  ref <309>: DATABASE ENTRY DATE: 2007-03-06
  ref <313>: RELEVANT RESIDUES IN SEQ ID NO: (1)..(953)
MSTTENHSDPTASKTSPAPSTAGSTGTSGITVRTGPNGHMSFRRQRASRACEDFCLANMIFSCTCEDMPCSKSESIPLFLRVRCDAASLGVPCTNCVAFSIECKIPTPKRKKNQTKSKETSGGEEAESKSPQSKPEPLPVESGKDAFGYQRNRMAVDGMPVTSLTESQAAQQASQNSMYAQFMKPKFARAPIKEAGRVAYLGESSNLSLLVQDRHGTTDVVHYPLPPNMGGTPARLTDLDSLELDILHQRGAFLLPPKPLCDELVEAYFKWVAPVVPIVNRSRFMRQYRDPKNPPSLLLLQAILLAGSRVCTNPQLMDANGSTTPAAMTFYKRAKALYDANYEDDRVTIVQALVLLGWYWEGPEDVTKNVFYWTRVAMVVAQGSGMHRSVESSQLTKPDKRLWKRIWWTLFTRDRSVAVALGRPIGINTDDSDVGMLTEDDFIEDEIDIAAEYPPDPVHVQFFLQYVKLCEIMGLVLSQQYSVASKSRRMNAMDLTHSDMALADWLQNCPKEVCWQRQRHHFWAALLHANYYTTLCLLHRAHMPPASSVSSNYRVEEMAYPSRTIAFQAAGMITSIVENLQNHTEIRYAPAFIVYSLFSALIMHVYQMRSSVPSIVATCQERINICMQALKDVSKVWLVAKMVHTLFESILGNKVLEERLQKAAGKRHQRVRPEAAQQPPAKKPEPPKRKFDEMEFGLPNGGGPTPPVSYERSRPQTPAVTPSREMQPPGLNLPQGSPPAPGQPGASRGNTRPTTPFNQYSLPATPPDLFLVTRTSPNLSPSLWENFQPDQLFPDGTTFFPELTSPQPNTVDPQLQMQSQLQAQGMDQRAMMPQQVPGRGSISAAQGSPEVMSTLTPAIGLPGQHSQQVFGIESQQGWPMQNMDATLGGAPMDAASQDDNWSSSSRSGPTAPTTLNVEDWFQFFGINGSFGDLATESYIQVSPVVGDVDEGHS

SEQ ID NO: 16 - protein, 640 aa, Aspergillus niger
  ref <308>: DATABASE ACCESSION NUMBER: UniProt A2QF42
  ref <309>: DATABASE ENTRY DATE: 2007-03-06
  ref <313>: RELEVANT RESIDUES IN SEQ ID NO: (1)..(640)
MKFNALLTTLAALGYIQGGAAVPTTVDLTYADISPRALDNAPDGYTPSNVSCPANRPTIRSASTLSSNETAWVDVRRKQTVSAMKDLFGHINMSSFDAISYINSHSSNITNIPNIGIAVSGGGYRALTNGAGALKAFDSRTENSTHNGQLGGLLQSATYLSGLSGGGWLLGSIYINNFTTVSNLQTYKEGEVWQFQNSITKGPKTNGLQAWDTAKYYRDLAKVVAGKKDAGFNTSFTDYWGRALSYQLINATDGGPGYTWSSIALTQDFKNGNMPMPLLVADGRNPGETLIGSNSTVYEFNPWEFGSFDPSIFGFAPLEYLGSYFENGEVPSSRSCVRGFDNAGFVMGTSSSLFNQFILKLNTTDIPSTLKTVIASILEELGDRNDDIAIYSPNPFYGYRNATVSYEKTPDLNVVDGGEDKQNLPLHPLIQPARNVDVIFAVDSSASTSDNWPNGSPLVATYERSLNSTGIGNGTAFPSIPDKSTFINLGLNTRPTFFGCNSSNITGHAPLVVYLPNYPYTTLSNKSTFQLKYEILERDEMITNGWNVVTMGNGSRKSYEDWPTCAGCAILSRSFDRTNTQVPDMCSQCFDKYCWDGTRNSTTPAAYEPKVLMASAGVRGISMSRLVLGLFPVVVGVWMM

SEQ ID NO: 17 - protein, 607 aa, Aspergillus niger
  ref <308>: DATABASE ACCESSION NUMBER: UniProt A2QFE9
  ref <309>: DATABASE ENTRY DATE: 2007-03-06
  ref <313>: RELEVANT RESIDUES IN SEQ ID NO: (1)..(607)
MKPGYCLLLAASAALSCASQHPIVDLGYAIYQGSYSTAYDLNVWKSIRYAAPPVGKRRWQAPAPPLQNNSQITLAVDQPPVCPQSGAAKTPYIYGFNSGPGDEDCLYLNVYAPPNATDLPVLLWIHGGGYGLFGATYDPSPMMNTNNNGFITVEIQYRLGAFGFLASEEVKEHGVTNAGLLDQRFAIQWVQEHIAKFGGDPKRVTIGGESSGAGAVMLHALAYGGQEFNLFNNIIAASAYSPPIFNYHDQVPEQYYKDFAEVAGCGSNSTAIKNYATTFDCLVAAPSTLLQNASATVSTSGLFGTWAFLPVIDGELIQERPSVQLAQGKVSGKRILIGNNANDGVPLSNPNVVTRPAFNSYISSTFPLFTSSDIALLNEVYQTANSRPADNSPRYDTIGTSGPTAINQSEMATGLQQTVFNIYAETTFACPAQWLADAFSQEDDTLSCSDSQTPRQAWKYQYSVTPAYHGADLSAYFSADATWPDKGFRTAFQKMWGQFIMADNPVISMEDATAGKLNASVPVARFGRKNSHGKNGTGMLDWPSYSPEFPVMMDLNTTGGYLVHDVVTSNLSYWIREGDGVVNHFRLVNSSAWEGGRGARLEIEWNE

SEQ ID NO: 18 - protein, 582 aa, Aspergillus niger
  ref <308>: DATABASE ACCESSION NUMBER: UniProt A2R215
  ref <309>: DATABASE ENTRY DATE: 2007-03-06
  ref <313>: RELEVANT RESIDUES IN SEQ ID NO: (1)..(278)
MASALLWLSLLGGSTLASTLDTSNTPTIKRADAGNNTSSIPTATLNNTVFIGRSLPEFEQELFLGIKFADEPVRFTPSTLKTVYRANDSDNGVYHASTASGLQTSSGTVLYNATEYGYDCPGYGSDETELAEEGYARFDENCMNLNIIRPKREKEDELLPVMIWIFGGGWVQGATADPRYNMSYIVRQGALNDKPVLGVSINYRVAAFGFLDSVEVMESGNTNLGLRDQRVAMHWVKQNIKAFGGDPDKITIWGESAGAYSVGAHLVTNDGDNEGLFRAAIMESGNAVGPPYNGTDWYQPMYDQIVNATNCTTSSNTLQCLREVPFSTIYTAADIGLEWFATIDGTFIKEYPQISITEGRFAKVPILHGTNTDEGVSFGTTGVNTDAEAIQQLMASKRWVLNETQATTLLSHYPNISALGCPYGWGNTTWPKLGYEYKRYESMAGDLCMVAPRRLLSQKMKEYEEQVFAYRWDVAALNDSSTIGVAHFAEIPFVFANPVQNITPLGSDPARLELGNLAARMWTAFVTDLDPNGHGVSGIPHWPKYNLTDPRDFVFRLPRDGSYVEKDTFRTGGIDYINTIVR

SEQ ID NO: 19 - protein, 637 aa, Trichoderma reesei
  ref <308>: DATABASE ACCESSION NUMBER: UniProt G0RQN5
  ref <309>: DATABASE ENTRY DATE: 2011-10-19
  ref <313>: RELEVANT RESIDUES IN SEQ ID NO: (1)..(637)
MFAILENVYDDLRKDDLELSREAFIEFLRDVQGEATIQLDKERFSLGDFIYTLAHAYRWDAVRKPSQKDYSKPITNYFINSSHNTYISGNQLASKTSPEAYMNVLKRGGRCIEIDVWNGDEVLIPGASKSPAGSGHTRALSGISGSSLPYAAAAVIERVEDKLEAAKDTAKGYLGSSSGNGRSRSTSTNSRTMTDDASSSSSNVYLAVDGSASTEKLEVPRQSRTRQTLPRGEPIVTHGWTFTTPCGFREVCETIRDHAFSHGNDLPIIISLEVHADHNQQEVMATIMKEVWGDMLIQEPYEGCDPKFRVPTLDDLRCKIMVKVKRAVAKIDHHPDATASLPVLQAEDDGSTSDDEQRPTPLLRAAVSSPPGAPLSDLAVYTRSERFKSLSTPQAKQPTHIFSISEDRILELHDKFPREVFTHNKNFFMRAFPAGRRINSSNPDPTLFWRRGVQMVAMNWQNMDEGMMLNEAMFAGEDGWVLKPAAYQGADKLSVTLDHAAKHTLDLTLTFFAGHNIPAEEEDEGDNPRSRSALRPVIKAELHIGETDKDGHEHSSHHKSAGEKLQFLNIPKVVEELSFIRLKIEDASHTVSSPCLAWACIRLDRLQQGFRFIRLHDMKGNEIIGGKLLVKVEKVLR

SEQ ID NO: 20 - protein, 648 aa, Trichoderma reesei
  ref <308>: DATABASE ACCESSION NUMBER: UniProt G0RX90
  ref <309>: DATABASE ENTRY DATE: 2011-10-19
  ref <313>: RELEVANT RESIDUES IN SEQ ID NO: (1)..(648)
MSRQLAALLAAAAVLAPAGASAVPPQDIRYRDLQEFPRSLEGRATDQSPKGYAPSAVDCPSDRPEIRIGSDLSPQEKEWLPRRRNATVEPIRDFLKRVAIPGFNSDRYLSNVEKDPKALPNIGLAVSGGGYRAMLNGAGAIAAWDSRSPGSNDTGNLGGLLQSATYLSGLSGGGWLVGSIFTNNFTTVQGALNSGTIWQTQNSILEGPEQYSLLSYYNDIFDDVDAKDKAGYDRSITDYWGRMLSYQLVNATNGGPGFTFSSIADDPDFKSARTPLPFLVADGRAPGQTIISNNSTVFDINPWEMGSSDPTVNGYVPLKYAGSRFINGSLPKNESCMVGFDNVGYIMGTSSSLFNQIVLYLRDDRSQYVPKGVPDFVVKILAGVLTVLGNENNDIADWTPNPFRGWNPKNNPGAGSERLTLVDGGEDLQNVPYHPHILQARKVDVVFSVDSSADTDNGWPDGASIIATYERAIDKISNGTGFPYVPGKNTFLNLGFNTKPVFFGCNSTNVTGESPLIVYLPNYPYQFHSNISTFQMSTELDERDAIVTNGWDVVTQGNSTRDANWPVCVGCAMLARSFERTRTPVPDACSKCFQQYCWNGTLAEQAPGEYDPTFFSTPIEIESLGAKSAGGATLVTALAAVVCAVLLM

SEQ ID NO: 21 - protein, 874 aa, Aspergillus niger
  ref <308>: DATABASE ACCESSION NUMBER: UniProt A2R903
  ref <309>: DATABASE ENTRY DATE: 2007-03-06
  ref <313>: RELEVANT RESIDUES IN SEQ ID NO: (1)..(874)
MTNTAVSTTSPTPQSTVETEAKSKRKASTAGLPANARPVKRRASKACCCCRARKVRCDVVENGSPCTNCRLDQVECIVTESKRRKKSRVEVENANPHQLSQSPAEIPDDGASLFRRLSECHGLSDMAPASPSQRSVDLDQGQHMPHLLYQSQANRIGSGDRFRRRMAPNPAVPATLPLHHVTSQIQQLLDPSFANARSGGVVLPDYIRGLPPRLQKEDIDYLSMKGALTVPDVGLRNELLKSYIHYVHTYMPLLDLEDFLQTIVQNDGIRRMSLLLFQAVMFAGTAFIDLKHLHAAGYPTRKAARKAFFQRARLLYDFDYEVDRISLVQSLLLMTYWYETPDDQKDTWHWMGVSLSLAHTIGLHRDPGNSRMDVRRQRMWKRIWWSTYTRDRLIALGMRRPMRVKDDDCDVPMLTLDDFEFHPFSPEIVSMVGNSEILQSVSHQRELALMFIEKAKLCLCVSHVLSAQYSVLSHKFGGTMETTMMLVPKKSAAETFEVRRCDQELEDWLAHLPTEIRYAPAAPSKLNEAQEVLHSHRALLKMVYLTTSSALHRPQVLPAIPFPSMDAELQEISRNKVRFAAIEITNIAQDLHSLDLTRYFPTTGVTVLLPAVIIHLLDIKSSDHNVRMTSLHRFYQCMRILQRLREIYASADFATSFLEAAIRKAGIQLTVAPQDVQARTNNIVDTSARVNTLTPPPDSLAQKIPDLTYPKSDGARRASQLPKESGPEFASTPPPSDGSENGSTSNINPSYHQDAFTIPNFDSELSISELMDLANDAEVTQNDFDALINFDDAGADFLAPDDGLNTGNGNGKNYGFGLGTMNNLSDIMGFDAEKQGVDLTGLGDGQLADDRAAALRNDMNTFAADLDAEVGLSL

SEQ ID NO: 22 - protein, 1531 aa, Aspergillus niger
  ref <308>: DATABASE ACCESSION NUMBER: UniProt A2R350
  ref <309>: DATABASE ENTRY DATE: 2007-07-24
  ref <313>: RELEVANT RESIDUES IN SEQ ID NO: (1)..(1531)
MATGDGIIAAPPSLESSSLDPLHVLPASSSTAARSLATSIPALTASFSVVSGFSSHLPPPPVTPPAPSTMVGWIGWIFSFIFQVIPSVLYWIVTFTTITLPTWLFTLFSMSLTFTMNFTTLLLIALAVVSTISWFIRYRFLNMYSRLPPEPQRKEPQLDLFPDVPDSDTKPGLANYLDEFLSAIKVFGYLERPVFHELTRTMQTRKLIAGETLLLEEEKGFCLVVDGLVQIFVKSMRDRKSGSDEELNRMAGESSDEDDHRPDGRQGYQLLTEVKNGASMSSLFSILSLFTEDVQLRYADSSASSASSIGPGLAIGPDSFPASPREMDDSPHVYQGDRLDPASHRNSTAEDLPAVPPLNLGESQVPPAHSARSESRKYSGKTRRKSVHPDIVARAMVDTTIAIIPASAFRRLTRVYPKATAHIVQVILTRLQRVTFATAHSYLGLNNEVLGIEKQMTKFTTYDLPNELRGSALDRLKDKFIKERDRLGQEEVTKGIALHNPYGGRRPRSSSFRRKEAALQAKMVASKRPVSMVAQDSALSDRENSGVSPGDLLSTIQLSRFGPRYEHLAPRLLSPLTEKEHSPLRSPSPMIPGRASPFHRKESLDEDALFRESILECIMKGIGLTGSTNDFLRKSSHPSGDVSPKLLSYDSRRQKAVFSNNAFGFIDPYEGSADGESESMMSMSVTSAGGTSPIVNLREELRNDIEIVYFPQGSVLVEQGERHPGLYYVVDGFLDVGIPVDDKEEDLVGSSRPAHEELFPMLRRTNTSSSRVSGSAAAANDPRRKKQSRRSLYLIKPGGIQGYVGAVASYRSYTDVVAKTDVYVGFLPRASLERIAERYPLALLTLAKRLTSLLPRLLLHIDFALEWVQVSAGQVIYHQGDESDAIYLALNGRLRSVHEGPNGKMTVVGEYGQGESVGELEVMTESTRPATLHAIRDTELAKFPRTLFNSLAQEHPGITIQVSKLIAQRMRDLVETPLAEKGGEPGVSGTVKTAKSTLNLRTVGILPVTAGVPVVEFGNRLLQALHQIGVTNGATSLNQAAILNHLGRHAFSKMGKLKLSQYLADLEEKYGMVLYIADTSVNSPWTQTCITQADCILLVGLAESTPSIGEYERFLLGMKTTARKELVLLHGERYCPPGLTRQWLKNRVWINGGHHHVQMAFRLTAEPSHPQTKRFGTVLKQRVQVIQAEIQKYTSRRIRQSPLYSAQTPFKGDFHRLARRLCGRSVGLVLGGGGARGIAQVGVIKALEEAGIPIDVIGGTSIGSFIGALYARDADVVPMYGRAKKFAGRMGSIWRFALDLTYPTVSYTTGHEFNRGIFKTFGDSQIEDFWLEFYCNTTNISRSRAEYHSSGYTWRYVRASMSLAGLIPPICDEGSMLLDGGYIDNLTVDHMKGLGADVIFAVDVGSIDDNTPQVYGDSLSGFWAVVNRWNPFSSCPNPPTLSEIQARLAYVSSIENLERAKNTPGCLYMRPPIDPYGTLDFAKFDEIYQLGYAYGKNYLEKLKREGSLPLPEETEEKKKLQRTLAPRRASI

SEQ ID NO: 23 - protein, 552 aa, Aspergillus niger
  ref <308>: DATABASE ACCESSION NUMBER: UniProt A2QZN6
  ref <309>: DATABASE ENTRY DATE: 2007-03-06
  ref <313>: RELEVANT RESIDUES IN SEQ ID NO: (1)..(552)
MPSFTTKGLASVALGAAVAQAQLWDQVIQTNYGPVKGFKYFTNETVLQKYFGTTESNVTAFLGIPFAADTGYQNRWKPPQPREPWNETLNATSFGPACPSNYETYISEDCLSLNLWTNAASADAKLPVIVWNQGSDETSDNAWWYGGGMAMKDVILISFNRRDDAFGYLALPELNAEGLATTGHNTSGNYGVLDQLEVLKWVQKNIANFGGDPDRVTVAGQSFGSSQVYHAVNSPLFSGYFHGAISESGIRYPYDPLLAGLATSYVNMSTAITHSEAYMSEHNVSSVAELRELSMEDLLIGSQDRVNDTWIWWVTALSAGYPLIFKPVLDDYVLPSTYLETLINGPANDVPVITGNTKDESGASTTTDYTVHEYLNYTSLKYGDLFDRYIKLYPTDNNATTADRSWNAAARDASLIGSWAYATDWYKAAESDFYTYYWTHAPPGQTQGAFHQSEIMYALNALYANADTYPFTDVDYDIGEKMSAYWANFAKTLNPNQGGSYTGKGSLPNWSPNSPNGTQVVMELGNYFGNVPIAHPSQVKLIMDWFHQQIPY

SEQ ID NO: 24 - protein, 544 aa, Aspergillus niger
  ref <308>: DATABASE ACCESSION NUMBER: UniProt A2QI32
  ref <309>: DATABASE ENTRY DATE: 2007-03-06
  ref <313>: RELEVANT RESIDUES IN SEQ ID NO: (1)..(544)
MAVLETFGHPYLKSLAHRGYVQGTTLHSKATSQPLCHYFGCVRYALPPPERWRRAQKLPESYSYGTKDQPAPCDQDAAVCPQPSFMGRSYTKGFTEDCFQASVWVPLGEPPKGGWPVLFFIHGGWLQFGHPNTFSAAALLGDAGLNAIVVVPAYRLNVFGFLYSSEIEKDASSVGETTGNHGFWDQREALEWTRDNIGLFGGNPSQITVSGYSAGAYSTFYQLAYDLQFPASRAIIKQACIWSNAAAVQPKSPASAQEQFDQLLSALHIPSTLPWAEKISQLRALPSQTLLDAAMSVQLNQFRPTSDSTFIQPTLFKSLDSGAFARALSARNVRIMLGECRDERHLYAAWFPPQADTLSALHSRLLADYPRHVVDTLVKLHYPDGKLPPCCENWDNDAFGRVYAKMQVHDMQRGLIHALASGGAGHLLYRYRIEYRAKCADASVPPEWEVTHSSDYPIWFWGNGNVLEPEEKGFIRRALIDPFISFVHGVEDVKWGTRHHREMRTLKPDGSVEIVQDTALWDEAMRVWKALREVGEPEASAAKL

SEQ ID NO: 25 - protein, 1099 aa, Trichoderma reesei
  ref <308>: DATABASE ACCESSION NUMBER: UniProt G0RGQ7
  ref <309>: DATABASE ENTRY DATE: 2011-10-19
  ref <313>: RELEVANT RESIDUES IN SEQ ID NO: (1)..(1099)
MSSQSKPLPRPSPAHVQTNLGMQRPAAAPPSAISASSKASNSQHGSPIMSPESLFTTNSSIQASPDCIRPQLDDPVSSGFQLPEAIISRRTSANSLGPSCSGSPGAPADGLIRRISSRASRRLSSKGRQNSAAPSSRETSVGPCFWRKRSDSSVTVPEFGLVNTDSESDMEDDWVSWSANYFDGTRDSPTDSTTGSISSKSNTMEGPVIPLQLKQGTLLKKVSKKNRSKLVLLSYDPETNKLLWDRARPHKFLHVDEIKEIRTGSDVQQYCRDFGIPEWERSRMFSILYAVPDKSKFKFLHLIADVTEIYQMWTTFLYDMLRHRQEVMTSLMTFNEKAINQYWQSEMQKHNSEDQEELDITGVKRICQNLHIYSSQAILEVNFRLADARGHGKLNYPEFLKFVRLMRQRHDVRQLMKSIAARPEVGLTLDEFLDFLRNIQKEDVSNRAAWEKTFTKFVRKHRNDDPSAEVSAEDLSIMSETAFIGFLSSRQNMPTIDEQQEFTLDRPMNEYFISSSHNTYLLGRQVAGQSSIEGYISALVRGCRCVEVDCWDGNDGQPSVVHGRTLTSAISFQEVMTTIQKYAFVKSKFPLWISLEVHCNPTQQAIMAKIMKDTLGDMLVTEPLDPNSSKLPSPSELMERILIKVKQPRMSKDDAASGDVLNTRKRGNSLSSSFTRPANSDPPALSTSQSVPQSPLLNPSNSRNLKFAGKSRVNTIAEGEVQEPQANANSDTDSGSEHGSSKGSNNIVPVLGKLGVYCAGLKFSGFDAPAAKKFNHIFSFMESSFAKHARTKEEKMQLDIHNMRYLMRVYPDGARLTSSNFDPISYWRRGVQMAALNWQTFDLGMQVNQAMFEGGTDSSGYVLKPQELRDIQVLPYNQAVNEALAQGKKERSVVSFGIDVISAQQLMRPANLAASKSMDFYVDVDVFHANDKRNKKDRDLELCHEPDSPLLRHTEVIRENGFNPMFNNGQFRFKVTTKHPELIFVRWSVRLSSDGESYSSSSKEKPPMASYTAKLSNLRNGYRTLPLLNHAGEQYLFSTLFCKIDVDPIEKKYIDVPQTAQEGGSKLNRLGGRVFGRTSGSPRSTMEKGSAEKRSFESN

SEQ ID NO: 26 - protein, 1499 aa, Trichoderma reesei
  ref <308>: DATABASE ACCESSION NUMBER: UniProt G0RLB7
  ref <309>: DATABASE ENTRY DATE: 2011-10-19
  ref <313>: RELEVANT RESIDUES IN SEQ ID NO: (1)..(1499)
MDSASSSLPVSYATVEAAHASPGWLGLIGWLLLGTINFTTTVLYWIIRTVTITLPTFLYTLFSASWTVTMNATTLMFIVVAIVSAVSWVVRYRILNMYSRLPPEPQRKEPEIDLFPDTHEGGIKSGLSNYLDEFLSAIKIFGYLERSVFHELTRSMQTRKLIAGETINLEAEKGFCIVVDGLVEIFVKSGRNFRAPVRSGSRNDLFDSSSDEDNLPGQQKYQLLTEVRNGAPMSSLFSIMSLFTEDVKLKRHDEDSPLAAGASRHARSDSVKESAAKVSHGPTSMPSTPHLDANVERPSVRYGDALLSDGASTPQIPPISLDPALSFQAGKQRAGLHSRSMSASAHPDIIARATVDTTIAIIPASAFRRLIKIYPKATAHIVHVILSRFQRVTLAQAFNYLGLTAEVLQTEKDMVKFTMCQLPNILRGDALTRLKEKFNRERERIGEDQETKGIALHNSAANRRRRSSAALRKDLVMQAIAKNRSASSTINNAASARDLRLARGLNPGDLLSGAQPNRPHNKSPYPGSLVRSPAYMGTEDSGPFSPLTQKTFNPFDSGRHARISTDRDSVDEDNLFRVSILECVFKALGLDAGGTSSRDVDSVEGSPRLTGSPRLISTDRRSKTLYTSNAFGFIGPYDGSIDGETESLASNGLAAHTPPNAHALAHDMMDEVEIVFFPKGSVLVEQGERSPGLYYVVDGFLDIGTTVTDGVQNIFQKSGPASFSAESLHADHRFESPGSKASVHGTPHSSQPDQNRRRSVALIKPGGLAGYIGSVSSYRSFIDVVAKTDVYVGFLPRASLERIVDRYPIILLTMAKRLTHILPRLILHIDFALEWVQVNAGQVIFHDNDESDAIYIVLNGRLRLVEDRQDGGVSARAEFGQGESIGELEVLTETARSGTLHAIRDTELVKFPRTLFNSLAQEHPNITIKISKIIASRMRAAVDDSTKYVAKEAGSGAVTNQRKSTLNIRTVAILPVTAGVPVVEFGHRLMNALAQVGPQNGATSLNQSGILNHLGKHAFNKMGKLKLSQYLADLEEKYGLVVYVADTNVNSPWTQTCITQADSILLVGLAEGSPAIGEYERFMLGMKSTARKTLVLLHTERFSRPGLTRSWLRNRMWINGGHYHIQMPYRTDAMPVHPPSKKLGQALKERVQVLQAEIQKYTSRNVHHTQYYSPDTPFKGDFHRLARRLCGKSIGLVLGGGGARGISQIGIIRAMEEAGIPVDIVGGTSIGAFVGALYARHADVVPMFGFAKKFAGRMASLWRFALDLTYPSASYTTGHEFNRGIFKTFGNTQIEDFWLEYYCNTTNISKSRAEFHTSGYAWRYIRASMSLAGLLPPLCDEGSMLLDGGYVDNLTVSHMKDLGVDVIFAIDVGALDDDTPQTYGDSLSGFWAFFNRWNPFSTHPNPPTLAEIQGRLAYVSSVDALERAKTMPGCIYMRPPVDGYGTLDFGKFDEIYKMGYEFGREFFQKLKEENKLPLTEETEAKKALRRTTAPRRASI

SEQ ID NO: 27 - protein, 921 aa, Trichoderma citrinoviride
  ref <308>: DATABASE ACCESSION NUMBER: UniProt A0A2T4B416
  ref <309>: DATABASE ENTRY DATE: 2018-07-18
  ref <313>: RELEVANT RESIDUES IN SEQ ID NO: (1)..(921)
MDGEVPSGDGASRVSPQQQQQQQQSQPQAQPQSKTSPLPSAAASAAAAANQMSFRRQRASRACETCHARKVRCDAASLGVPCTNCVAFQIECRIPRPKRKKTQATGAQANKDSDSDRGDNTDEPSRQTPQSSTATPYSPRASAPTVSHTADGTPPTSLTEAQARKEEVDNGTYLNLVMKPKFTRAPITEAGRVAYLGESSNLTLLVHDRQGSADVVHYPLPENVRGSRARLTELDNVEIDILHQRGAFLLPPRSLCDELIDAYFQWVHPIVPVINRTRFMRQYRDPKNPPSLLLLQAVLLAGSRVCQNAQLMDANGSTTPAALTFYKRAKALYDANYEDDRVTIVQSLLLMGWYWEGPEDVTKNVFYWSRVATIVAQGSGMHRSVERSQLSKSDKRLWKRIWWTLFTRDRSVAVALGRPVHINLDDSDVEMLTEDDFIEDEGDRGSEYPPDPIHVQFFLQYVKLCEIMGLVLSQQYSVASKGRQRNAIDLTHSDMALADWLQNCPKIVYWEMPRHHFWSALLHSNYYTTLCLLHRAHMPPSGSPRFPNDTPYPSRNIAFQAAAMITSIVENLAAHNQLRYCPAFIVYSLFSALIMHVYQMRSPVPSIQQVTQDRLRSCMQAMKEVSRVWLVGKMVYTLFESILGNKVLEERLQKAGGKRHRKMQQTVAQLEQLNNNRHDSAKRKYDDMAMDFMSNTPTPQESYERSRPQTPSATRSENTGNPGQRSSAASPTVRHTGADTFMGGTNSRPQTRPATPFNPSFSLPATPPDLYLVTRNSPNISQALWENFQPDQLFPESSSLSAFPNLSPTQTHQTLDQNALNQMPGGGVATGIQTNQYRGSGQNASQGAAGMVPMSGFQGQQSSLWQSGFDGGLQDSNSPDSWGTSSAQGQPAPTTLNVEDWFQFFGINGDMSSINLDMPLG

SEQ ID NO: 28 - protein, 621 aa, Aspergillus niger
  ref <308>: DATABASE ACCESSION NUMBER: UniProt A2QKQ5
  ref <309>: DATABASE ENTRY DATE: 2007-03-06
  ref <313>: RELEVANT RESIDUES IN SEQ ID NO: (1)..(621)
MWFALGFLPSTTAAPSQINNRRARTDVSVERRDLSTATNPYAPVHVSCPPNRPSIRGAATLSPEEVSWLKTRREQSLSGLKEFFGHVEIDCFDALDYLDTSDSSSLPNVAIAISGGGMRAMLNGAGALKAFDSRTEGTAAEGQLGGLLQSSTYVAALSGGSWLLSSVFMNNFTTISALQDSFWDFSSASILEGPATMEPTDFWGNVTAQVKAKRAAGFTTTDADIWGRAEGYYFLNASHGGVDIHWSSIAKTPSFQHGDMPLPLVVVDGQSFADANDEPGQDKPIYEVSPWEFGTYDDNMYGFAPLEYLGTRFVNGQVPENETCVRGFDSAGFITGTSSDIWNENGTGIAATLRDAIAEVSTNTTEGALEVELLSFMLEEVVSALSSNNTAISGPAAYEPNPFYKYNANTSPFAETTRLTVVDGGEDEENIPLNPLIQRKRDVDVIFAIDSNNNNAGYKWPTGESLIATYERTLAGYANDTSFPSIPDENTFVNLGLISHPTFFGCNSSNMTTPAPLIVYLPNHPVTYMSNTTTTDTTFNTTARDAMITNGYNVATQANGTLDNEWTTCVGCAVLSRSFDRTNTPVPAACDRCFQRYCWNGTLDTSTPAVYDPSIIFPSGL

SEQ ID NO: 29 - protein, 531 aa, Aspergillus niger
  ref <308>: DATABASE ACCESSION NUMBER: UniProt A2QG33
  ref <309>: DATABASE ENTRY DATE: 2007-03-06
  ref <313>: RELEVANT RESIDUES IN SEQ ID NO: (1)..(531)
MRLASGFLALTCLVPGILATAGLESSDANGDSLTVRTRTGVYTGVVEDQYPNTRIFKSIAFAEPPVASRRWLPPAKLPNSTTHHTTYHYPPSCPQFVSSATSLWNQYLGPGDEIYNGNQGYSSGLVGEATSEDCLYLAIWTPANATTASKLPVLFFMTGGAFTTGGINIGWQKPTNWVERTQEHIVVTINYRVNIFGWPNARGLKEQNLGIMDQRAALEWVYENIEQFGGDRYKIVQWGQSAGSQSVDFHSYAYHDNPLVCGYFMQSGTALKSLGFSDYDQTNFTFVAKQFNCDFPNPAAELECMRQIPFAQISNFIGQYSDNGTEPALSFSVVPDERLIFSDYPARSAAGKVAHRPAIISNCANEYASLITYPVNNLTAGPDPDAVLEGDLTDWICPTANSTLLRNQQNISVYRYQNAGQYPNLNPFRWLGAYHASDLPMNFGTYPIQEYLGNSTTFEAEVSRTMQDHILAFLKDPLNGPQSLGWQPVNSSLVSGGKVLRFGADGKAVQQVDRVEIDGPCRGIGQYNQFP

SEQ ID NO: 30 - protein, 574 aa, Aspergillus niger
  ref <308>: DATABASE ACCESSION NUMBER: UniProt A2QIR3
  ref <309>: DATABASE ENTRY DATE: 2007-03-06
  ref <313>: RELEVANT RESIDUES IN SEQ ID NO: (1)..(574)
MRSPAWAPIATTAFAALANAATPSTLAELCTDSIVKAALPPSEFIQGITIDSDSVTTEVVTNSSVSSEFYPSATINYCNVTFAYSHDGIDGDQVLLEIWLPAPTDFQNRWLSTGGGGYAINSGDQSLPGGVMYGAASGMTDGGFGGFSNNADTAMLLANGTLDYETLYMFAYKAHRELSLIGKALTRNVYGMSDSDKLYAYYQGCSEGGREGWSQVQRFGDEWDGAIIGAPAFRWSFQQTQHLYSNVVEKTLDYYPPPCELDKIVNETIAACDAMDGKVDWVVARTDLCLLDFDISTIEGKPYSCAASRGTPAQNGTVSAKGIEVAKTIINGLHDSQGRRVYFSYQPTAAFDDAETQYNSTTGQWGLDIDQLGGEYIALLVDKNGTTLDSLDGVTYDTLKDWMISGLQEYYSTLQTTWPDLTPFHEAGGKVIHFHGDADFSIPTAASIRYWESVRSIMYPNQDYNSSAEALNEWYRLYTVPGAGHCATNDAMPNGPFPQTNMAVMIDWVENGVVPTTLNATVLQGENEGQNQQLCAWPLRPLWTNNGTTMECVYNQRSIDSWHYDLDAVPMPVY

SEQ ID NO: 31 - protein, 594 aa, Aspergillus niger
  ref <308>: DATABASE ACCESSION NUMBER: UniProt A2QEJ2
  ref <309>: DATABASE ENTRY DATE: 2007-03-06
  ref <313>: RELEVANT RESIDUES IN SEQ ID NO: (1)..(594)
MDSSLSNAQKITLPFAPSMLNYIDKIYSSLTSMNQPNFLTDVQREPKGQGSTTKEHPAPLATLAAFYEYLASPEASAMRAATQMDLSAPITDYFISTSHNTYLTGNQLYSESKASAYTNVLLSGCRSVEIDVWDGKAEGFLGHHKPSTSSGSSGESKASGSAIPVPGKPEPRVLHGHTLTRETSFREVCYAIRDSAFVASDLPVIVSLEVHTCLEQQQTMVEIMEEAWKGMLVEVTPELEAGTVPPPPLADLKRKILIKVKHVESVDEGGDREAKEKAVYTQHMEALKQQKNPSNSVEASKGFESPESPTAAPHKPSKILQALSKLAVFTKGFHFSNFAQPEAKVPSHVFSLSEKAVREAHATDGDALFEHNRHFFMRVYPNGLRVDSSNMDPTFFWRRGAQMVALNWQNFDKAMMLNAGMFAGEQGWVLKPPGYRSSDAQPGIIEPRRLDLTIEFLAGQNIPLPPGHTNENKFYPFVTCLLHVETPDDSFAAADDDTESEKTGYKHCTKSVTGVNPDFGGQKMEFATVSGFLDELTFVRFKIKDNEWMHNALAAWACIRLDRLQEGYRIIHLNDSTGAPTEGALLVHITKTYS

SEQ ID NO: 32 - protein, 808 aa, Trichoderma reesei
  ref <308>: DATABASE ACCESSION NUMBER: UniProt G0RLB0
  ref <309>: DATABASE ENTRY DATE: 2011-10-19
  ref <313>: RELEVANT RESIDUES IN SEQ ID NO: (1)..(808)
MRYPVKLPRPLISLRSSLRASRRPPASATRLDRSFFTQSKRQKRQQPTSLPATVLALGLFTWWLYPTEDFARLSESQKAKRRRRAEEEEEEGDDETEDQESYQLVTEKTDDGAWAYFARQFEFFSSAAELEWAALSDRLVDAIIPEWWKNIPIYVRKLQRELSASPGSLAEEIWQEAHDPDINPEIQYSAAVRVSTELCDEEKEYLSRRRLVTRAALANYLGLDEQDIHPDDVPTIAMCGSGGGMRALIAGTGSMYATDEDGLFDCVTYTAGVSGTCWLQMLYLSSFARGSVSALIHHLKARASTHIAYPPVAFQSLTSLPTSKFLLSGLVEKLKGDPHADFGLVDIYGLLLGARYLIPRGELGVDARDFKLSNQRLYIRQGQRPLPIYTVVRHEIPAEEPQDTSDTTVPTVEEMRKEPYFQWFELTPYEFFCEEFSAGIPTWALGRRFSNGHDVSDHGFHLPEIRTPLLMGIFGSAFCATLSHYYREIRPLIRTITGFQTIDDLVSGRNEDLSKVHPIDPAIIPNFAYQMYGKLPSTTPRSILEGEYIQLMDAGMSNNLPIYPLLRPGRNVDILIAFDASADIKTDNWLSVADGYARQRGIKGWPVGIGWPKDETPEQARKELEEAQAATAAEAERKVEEARAEQEERRKASSDDQKKLDVESKFSPGSEKAGELGYCSVWIGTTEERSTDSPPITKPITDDTSWRLMEPDAGLAVIYLPLLSNEKVPGISPGTTDFLSTWNFVYTPEQIDSVVQLARANYDEGKEQIRATVRAVYERKKQLRVQGETRRLMVKGEADLLHHGDQFS

SEQ ID NO: 33 - protein, 902 aa, Sporotrichum thermophile
  ref <308>: DATABASE ACCESSION NUMBER: UniProt G2Q2Z5
  ref <309>: DATABASE ENTRY DATE: 2011-11-16
  ref <313>: RELEVANT RESIDUES IN SEQ ID NO: (1)..(902)
MEGQPSPPVEATPPKQPSTSPARSSTTPSTSGATTTTTTTAGQISFRRQRASRACETCHARKVRCDAASLGVPCTNCVAFQIECRIPQPKRKKAQGAVVPTRDSDSERGDEDRSPLPPGTTTFPSGTRPPAVYHTHEGTPSTANTEAEQQKKEEFDNATLASYMNLVMKPKFTRAPITEAGRVAYLGESSNLTLLVHDRQNDGDVVHYPLPENIRGSRARLTELDNIEIDILHQRGAFLLPPRALCDELIDSYFKWVHPIVPVINKTKFMRRYKDPKNPPSLLLLQAMLLAGSRVCTNPQLMDANGSSTPAALTFYKRAKALYDANYEDDRVTIVQSLLLMGWYWEGPEDVTKNVFYWTRVATIVAQGSGMHRSVEGSQLSLSDKRLWKRIWWSLFTRDRSVAVALGRPCHINLDDSDVEMLTEDDFIEDEPDQRSEYPPDPVHVQFFLQYVKLCEIMGIVLSQQYSVAAKGRRHNPIDLTHSDMALADWLQNCPKIVYWEVPRHHFWAALLHSNYYTTLCLLHRAHMPPSGSSRFADDSAYPSRNIAFQAAGMITSIIENLSARGELRYCPAFVVYSLFSALIMHVYQMRSPVPSIQQVTQDRIRTCMSALKDVSKVWLVGKMVHTLFESILGNKVLEERLQKAAGKRHRQAQQSLSQLEQHRYAQEQKRKYDEMAIDFSVGTPQPQESYERSRPQTPSLASKNEPGPNAMPPPNNTSPHTRNNGDAFMGGTASRPHTRPATPFNPSFSVPATPPDLYLVTRNSPNLSQAVWENFQPDQLFPESANAPLFQQLSPQQTPQSLDQQMMTQMQNQNMQGQPMDGGQNAYGQTIPKRGMGGSPMQQNAMLQPGMAGSYQGQQGSASMWQGYDAPMVDGQSPSDSWSSGSAPGQPVPATLNVEDW

SEQ ID NO: 34 - protein, 467 aa, Aspergillus niger
  ref <308>: DATABASE ACCESSION NUMBER: UniProt A2R7J0
  ref <309>: DATABASE ENTRY DATE: 2007-03-06
  ref <313>: RELEVANT RESIDUES IN SEQ ID NO: (1)..(467)
MKLNVAAISALATVASALPHRRNVEQWDHIRSNIKHVIYLMMENHSFDNIAGYWDFHPDIDNLRNISYCNEYTNPNWTVWDEPLNICAAPFETEVPLTDPDHNFAGTSYEIFRKWQPTKDDVPNMGGFIERQSEKYASSPGESSFVIKAYDEKKTATLIEVAKNFAFWDSYFAEHPGPTNTNRQFATSGSTCGFVDNTYQAAGWYANYTGTTCATSIFEALSNKNITWKNYYETDIVDAYMYKWVQDNAMDRLVHSDQFYRDLEEGTLPQFSYYNPECCTIDSMHPTSNMASGEQLIKHLYDAVRKSKYWDNVLIILNFDEHGGFADHVPTPINVPQPEDGITFTGMSDGHNVTYDFTRLGVRVPSFIISPYIPANHLIHDQGTMYANNSAYTHTSFLHFLQELWGLEGLNNRVQWAKTFEYIFSSEKRDDTPEKLTTPTWYGSSWEPKPDPYYKLNQNYDYYENLD

SEQ ID NO: 35 - protein, 581 aa, Aspergillus niger
  ref <308>: DATABASE ACCESSION NUMBER: UniProt A5ABE5
  ref <309>: DATABASE ENTRY DATE: 2007-06-12
  ref <313>: RELEVANT RESIDUES IN SEQ ID NO: (1)..(581)
MGVMRKTADQALGLTATALALVSAAQATSPSVTVSQGLIRGFEHNDTNVFLGIPFAETTAGENRWKAPKALSSFAGGEFNATTYGPSCAQAMSGTAITAQSEDCLSMNIWTPLSGSDLPVFVYVYGGAMVTGGSSNAQWQGYNFARKDVIYVNFNYRESIYASPNAPELEGQSQNFGIMDVDLAVQWVYDNIEAFGGNKSNIVLGGHSSGGVHVDHYLWNHPETFLAGAVEMSANAESGPAYAPTGVALAQVVEDMLAAGVTLGCDASNYTLDCLREADTYAFQTSYFNSTSNTWFSPIVDNITRFSNYTDRFAQGYYPKSLPLMVGNSDQEGRLFAYAYASENTKFNKWIHTFDADVAWVPSAELLAAYNSADYSSVSFESGACYGDARFLCATDYLVDVRSSEQPTWIYRWFGNYSNVLGIADIGPSHGSEVPFFHGGNECFSKLSDVTTAEQELADYMNDWFVAWIKAPSAGPGWDKAQPVNGPLARLGVPGNELAIEMSTTDIISFKDFISVSRLRLAPILAGSRLAPSAARLQLSLHVPGPERIVTRARRSPAGLQEHTTHHCATWCDAEDGRGQP

SEQ ID NO: 36 - protein, 550 aa, Aspergillus niger
  ref <308>: DATABASE ACCESSION NUMBER: UniProt A2QH76
  ref <309>: DATABASE ENTRY DATE: 2007-03-06
  ref <313>: RELEVANT RESIDUES IN SEQ ID NO: (1)..(550)
MSFQSPATTCTTEVPTLGQLEGFQFANGVQQYCGIPYADLPKRWTRSVLKTTWENSRHDGTKLGNDCPRPYSEGDDSDDLVPVPPAAHFPVLPKTDELTGLVMNIVIPFAPTSKKRSLPVMVYVHGGSLLYGGANLPIFDAVNLVSQSIEMEKPFICVNFNYRVGLGGFLASDAIRRDLRDDGFQGCGNFGFTDQQVAFDWVQRYIAALGGDPDNVTAVGESAGGISISNQLAAAHPPRFRRAVCMSGLSVSIPPWTMEQHETLFQAVCRYLKIDASQPDVLDRLRQIPQQDMANATPVIQGVLSGTGNPCFDGWFYQTDPCEIQTAPKWLEALMVGDTYHEGVIFHLNLLDDDFASIRRTFLKHINDDDETDQILREYDIHPALPHDMLLERVEHMCGDAVFKIPNYATALANSALHDRGSLFLYHFDQRSRLKNPLEGTAYHAHELLYLFRNLETEMDDGEREMARGFAAAWIRFCNGEAPWSASKAEWKVWGPDSVQSVKSEEEDENARSYKRMKRILGMGNGQTWKRWLTGVDVLVNKRMNMGKAA

SEQ ID NO: 37 - protein, 1156 aa, Aspergillus niger
  ref <308>: DATABASE ACCESSION NUMBER: UniProt A2QRK1
  ref <309>: DATABASE ENTRY DATE: 2007-03-06
  ref <313>: RELEVANT RESIDUES IN SEQ ID NO: (1)..(1156)
MAYAAASSPSTINGDTQASLKLTGSLPKPPKLHNVNTSVPPAPNPSSAPPCASLYSYTPNSLRPSYTFSNASSPSGTPLQSATDALRGRIPSFPLIPPAHLELGDSIMAVPGSASASGSGDAATQTTNKGPGLMRRISRGAANKLTRRRQSATQNDKRDRSSGPVIMRRRSDSKTGQNSWESALESSNEEDSNDALDSLGVWCGSEASSLQNEMFIPPTRTVSAVAPKVDAMIQRGVIFTKITKKRRKQVRFFLDLDAGKVYWDLSNPTKRFYVDDIKEIRVGVDARNYREEHQVSQDFESRWITVVIADAERSKGRSVKTLHLIAPSDYTLELWTTTLEHISRYRIGLMAGLAGSGQSEAVLKAHWQREMTRLYPKGLKLGELESLDFEAVESVCRSLHINCSKNMLRAQFSKADNNNKGKLYFSEFSDFVARLKERKDVKAIFKERVASSEGFTLEEFLAFLRDVQNEDVESDRSYWVSIFDRLVRKSRPRAPSLPEHPDGRPTGVPRLGLDAFTSFLSSSWNGVYASRAPQSRFDRPLNEYFISSSHNTYLLGRQVAGASSTEAYISALSQGCRCVEIDCWDGADGRPIVSHGRTMTTSVLFADCITVINRYAFISTDFPLILSLEVHCNPEQQLAMVRIMKETFKDQLVLEPLLTNTFVLPSPEDLKRRILVKVKTCDETEGGMRQESTGSSISVGRKRSSSSPFMHPTVPEYPPVSNLVPLAGPSTAGQDGIDTFLSQDRRSFTTTSISSATEDSDGALTSMKRERKRRQKSKITKPLSDLGVYTRGYKWHSFTSPESQRYNHVYSFAERSFESICRDADNKAVFEKHNRKYLTRVYPSGFRLRSSNFDPLKFWRRGVQMAALNWQTYDVGMQLNQAMYAAGTDRTGYVLKPESLRTVTTGEDRRKSTERKCVRFTIEVVSAQQLPRPRSLGPDDNINPYVEVEIFSADDRGQSFVFGEGGLNTSARSGVSGIGYPHRRRTKIEQSNGYSPIFNDCFKFALDTKYPDLVFVRWTVWSSLDGRSAGNNSSVQLATFTAKLTSLSQGYRYLPLYDAGGDQYLFSTLFCKITKDGITPAYFGRIDPDDLRAERLGLLRQIGQTVFKRSSSTEREKDSFSDKGSEIPMSSEDNHSPTSPTLTPTVSAASTSSLPP

SEQ ID NO: 38 - protein, 333 aa, Aspergillus niger
  ref <308>: DATABASE ACCESSION NUMBER: UniProt A2QNF0
  ref <309>: DATABASE ENTRY DATE: 2007-03-06
  ref <313>: RELEVANT RESIDUES IN SEQ ID NO: (1)..(333)
MQSPLAQKRLAGFDLVQTNYKTVGDHNLRADLIIPQSSYNTGKRPVIIHFHGGGFLTGDSLFFEWFPQYLFDIAKQHNAVIVSPNYRLLPEATGLDLFDDIEDFWIWLHSPVAAELLSSQPNPTELDLDRIITAGESAGGTLSICLALAHPEEIRAGTAAFPGMLSAPVEDVSVRKDRPRPSGLSLEEANRLVDEAIKDSEQGVVQSSLTPPERLTLMLASLESERLYELYERGTEKDPRRALRHPMERLDEPDVKFPRGGISIRHGLDDDIVPPGISQAFVDKARKVMKGKPGGDKIILALRPGGHGFEGETRGDEEWLQENLRAAIEAWLE

SEQ ID NO: 39 - protein, 886 aa, Sporotrichum thermophile
  ref <308>: DATABASE ACCESSION NUMBER: UniProt G2Q816
  ref <309>: DATABASE ENTRY DATE: 2011-11-16
  ref <313>: RELEVANT RESIDUES IN SEQ ID NO: (1)..(886)
MSYNRLDDDYYESHPLETRMHRTPSPTHPLQHGYHLEDNPYGHSQLDIPQGPGRYSPGDALHMQTAQSVDNLGSYSVNPEAHHDAYYNQPYEPHPTGHSGYDQTPYYDDDRRPMLAHNGSQVGASDPYHDNQQPRPNNGIKRWKTVKQVLLYRGNLVLDCPIPPKLLNQLPHGERDEFTHMRYSAATCDPADFYEENFTLRQKLFSKPRHTELFIVVTMYNEDEILFARTMIGVFKNIEYMCKRTESKTWGKDAWKKIVVCVVSDGRAKINPRTRALLAGMGVYQEGIAKQQVNGKDVTAHIYEYTTQVGMAIRNDVVQLIPKQQPVQMLFCLKEKNQKKINSHRWFFQAFGRVLDPNICVLIDAGTKPGSTSIYHLWKAFDLEPMCAGACGEIKAMLGTGGKNLLNPLVATQNFEYKMSNILDKPLESAFGFISVLPGAFSAYRYVALQNDKNGKGPLEKYFAGEKLHGAGAGIFTANMYLAEDRILCFELVTKRNCHWILQYVKSATGETDVPDTVTELILQRRRWLNGSFFAAIYAIVHFHQFFRSDHSLMRKLAFFIEFVFNTVNMIFAWFAIGNFFLVFKILTTSLGDENLLGEVGKILSVVFTWLYGVSLVTCFVLSMGNRPAGSGPYYMAMVVFWAILFIYLMFAAIYIAVNAIITDLNAHGFSIDSLFKNKVFYTLIVSVMSTYGIWLIASLLMFDPWHMFTSLIQYMLLSPTYTNVLNVYAFCNTHDISWGTKGDDKPEALPSVNTKDGQGKTDLPDEGDLNAQYERELQVFSRKPVKEVKPPTPSQIEEKQMDYYRGVRTVVVLVWMITNFALCAVVLSTAGVDKIVPGNGESEEEIKSNRANVYLSVVLWSVAGLSAFKFLGALWFLVVRMFRGV

SEQ ID NO: 40 - protein, 620 aa, Aspergillus niger
  ref <308>: DATABASE ACCESSION NUMBER: UniProt E2PT14
  ref <309>: DATABASE ENTRY DATE: 2010-11-30
  ref <313>: RELEVANT RESIDUES IN SEQ ID NO: (1)..(620)
MLSLLISAAAATLASALELPQGYSPDPVSCPTNLSWIRPAVGLSRDEAQWVEGRKNVILGSLDAYLKRLNLDDFDTDEYISRLNNTSQTPIMGMAISGGGFGSAYTGTGLIRALDDRLPAANEQRTGGLLQSMTYLSGLSGGSWPAVSFPSYNFPTADEIVDYWKPEIDRFFTVTNTSAEAATGKAIFEQIATKYLAGFEVALSDYLGRGFAYEFIPGQSGGLNTTFSGIRNLSNFINHQMPMPIIHLASVEPEDAEYYDLLVPSSNGTIFDLTPFEFGAWDGDVHAFTPTEWLGNQLSNGIPVNQSKCWKGFDRSSLVIGTSADAFNFWYLESVSNGTLGQFAKRSTTHESSLTKRLSQPANLNALVDAFQETFDLNLTQISYSKFPNPFTNLSLSTGNTHKSSTLNLVDGSETGQTIPLWGQIQPARNVDFIIAWDDSQDADPYSWNNGTNLYNTYLAANATGLPFPIIPPSRTMMNLNYTLHPQFFGCDANLTTTGDDRAPIVLYMANAPYSAYTNFSFWQTETSRQQMGEIFVNSFDIVTQANGSWDGEWAECMGCAAVERSLARVGMERTRQCQRCFERYCWDGTLDERDPGVLDPTLVLDPGVKFGLWNATNPY

SEQ ID NO: 41 - protein, 749 aa, Aspergillus niger
  ref <308>: DATABASE ACCESSION NUMBER: UniProt A2Q8F7
  ref <309>: DATABASE ENTRY DATE: 2007-03-06
  ref <313>: RELEVANT RESIDUES IN SEQ ID NO: (1)..(749)
MNGAEKSAAGDTYDPSTIPDYDREFIHPDDLRQFELALTDQGASPLVALNDWRPIYQRVRRERGRRKEPRRTKDETREGVLYTVLKWPFLFTVFGWITALAFAYTLTRVYIFLYEQWVTWRGRRQSLRRQLHAQTNYPDWQKAARALDDHLGNQRWKEIDEYAYYDHLTISNLVKQLKKVRREVERERREKRRGSGQSPAAEELCTLLEACVKNNFAGVENPRLYSEAYSGTKNLVQEYIDELHACIQLVADSKGITSEEKLQHFKHLDTNFGRTALCLSGGATFAYYHFGVVRALLDNGVLPEIITGTSGGALVAALVATRTDEELKQLLVPALAHRIRACQESFPTWVWRWWRTGARFDTLDWARQCSWFCRGSTTFREAYERTGRILNVSCVPSDPHSPTILANYLTSPNCVIWSAVLASAAVPGILNPVVLMTKKRDGTLAPYSFGHKWKDGSLRTDIPIKALNLHFNVNFTIVSQVNPHINLFFFSSRGTVGRPVTHRKGRGWRGGFLGSAIEQYIKLDMNKWLRVLRHLELLPRPMGQDWSEIWLQKFSGTVTIWPKTIPSDFYHILSDPNPERLARMLRVGQQSAFPKLQFIKNRLKIEIAVVKSLQKFAHAGGRPISPAPSRWRQNNDPDNHYNPSPRTDPLNERLDHNLPERRGDNVNITFGEGGGREDTHLLDGSLSENSSNESAARPSSSSSSSRLLRVPEHRRGSTGSSIFEEVRRQSAVFFDDVDMYGDDEALRPG

SEQ ID NO: 42 - protein, 545 aa, Aspergillus niger
  ref <308>: DATABASE ACCESSION NUMBER: UniProt A2R5R5
  ref <309>: DATABASE ENTRY DATE: 2007-03-06
  ref <313>: RELEVANT RESIDUES IN SEQ ID NO: (1)..(545)
MALQFLYLVTFLLAVLPPTLARNNCSIETFQAFLDANGTAARVVYARHYAENSTFVNPNISSVTNPTQLPAACAIQVNATTDVNTHFSFGVFLPDTWNERFFHAAQEGEDINWVDMAVGLRYGFASVATDTGHTGSDMDGDWWKNPESINDWAWRANHLTSVLGKFLVERFYGQKPKYNYFAGCSTGGRQAMKETQKFPRDYDGVIAACPAWWTTHQQLYNLKQTTYQAPQGSDHTIPMEMFAVIGAEAIRQCDPQDGLVDNIISDPLGCHFDYLPLLCTETKNTSCLTGPQIETLHKIYNDWVETNQTFVYTHPHYGSEAMWNESGVIGNGSVGNEDSQLWYPQHILGLANFTVQDFDYSVVQYADQTDPGNSSANSYDLAEFYRHGGKLIHYHGHSDAIVPPGIGLYYRDHMAATLAPQGIDIDDFYRFFAIPGMEHCYHTPSTMGAPWYIAGPTQASTLSSSLYSVPGYQDAKHDIFLALINWVENGTAPDYIIGSRFNSSVEYTSRTIDKQRPICAYPKLAQYVGSGDIDDAANFECKALY

SEQ ID NO: 43 - protein, 627 aa, Trichoderma reesei
  ref <308>: DATABASE ACCESSION NUMBER: UniProt G0REM9
  ref <309>: DATABASE ENTRY DATE: 2011-10-19
  ref <313>: RELEVANT RESIDUES IN SEQ ID NO: (1)..(627)
MPRFVTLAPASATLMAVIGLASAGSLKDIDHVVLFMQENRAFDHYFGTMAGVRGFADANLQMNDGVPVWKQVTNSQLTNETDYVTPFYINYLGGNWTEATQCMVSGSNSWQENHAAWNSGRNDRWAVDNSPYSIGFYKRQDIPIQFALADSFVVADMYQEAIVAATNPNRVTWLSGSVNVPGGPQTPDQGGNPYIDNNITPGCEPGGFNCYPLKWKTVGEHYEDAGVTWQVFQDADNFDDNSYARFQQFQDAEPGSSLYERGMKGLSLDTFYAKAANGTLPEVSYIVAPMELSEHPPYSPHDGAWLQHQVAQAVLNSPKYNRTALMISYDETGGWFDHVDPYRSPRDTAGEWIDDPYGQVGYTFVGPGFRLPFYIISPWTRNGGVFSAHSDHNSQILFVEKWQAAKGRNVTTEEMVYWRRSHMSDLVDAFDFDHPDYSIPQLPEPQTPHTDSNGVYDGSSYCQSLYSEVQPPVPYTGTGVIADLTTQVERGFKPLRGMLTEGRHLVLEANGFALTQKTSFLGTIVLSRATERHDAPSQRWIAHAVTVGGDEFTLSDDSGRNYICDNGQLCSDAGKAVVFTVGYKSGKGYSFGVKGTGRYLGVGGRGASSYASLNGGLGYWKVYSVSY

SEQ ID NO: 44 - protein, 553 aa, Trichoderma reesei
  ref <308>: DATABASE ACCESSION NUMBER: UniProt G0RBM4
  ref <309>: DATABASE ENTRY DATE: 2011-10-19
  ref <313>: RELEVANT RESIDUES IN SEQ ID NO: (1)..(553)
MIPSHLISHLIIHLLPLTHANPLPPQTDPCPEPPTPSSPIIDLGYAKYRGLTLPDAAVDTFLGIRYAKPPLSNLRFRAPQDPSPESSIQDASKFGPVCIGPGQSVSPSTTSEDCLFVNIFKPSNATPESNLPVWVYIQGGGYATNSNANYNGTEVVQQSGHGLVFVNFNYRVGALGFLASEHVRRDGHLNAGLLDQRKLLHWVKKHIKQFGGNPNHVVIHGVSAGAGSVTHHLTAYAAKRETNLFAAAISQSPFWPTLRSVHDMEFQYRRVLANANCSSLDCLRHLDTQAFLDAAPVERFEGVSSEDAPLPLWYWLPVIDGDLVTDHLYSQFQHGNFIRVPLIVSHDTDEGTYFGANASTAAEVEAFLLTNYPDLQPSQLSAISRTYSPEKLASLPDHAPYFPSAEAAYGDATFICPGNTVAAIAARHFDPRRVWNYRYNVQDPDLVASGLGVPHTVEMPAILGLGSVGGTPASYYTTNAAIVPVTMHYFLSFVMNLNPNVAKYATAPQWDPWGQGTGQRLRLQTNNTAMEPVPADQRARCRLWSHLQGYTQM

SEQ ID NO: 45 - protein, 691 aa, Trichoderma citrinoviride
  ref <308>: DATABASE ACCESSION NUMBER: UniProt A0A2T4BJU6
  ref <309>: DATABASE ENTRY DATE: 2018-07-18
  ref <313>: RELEVANT RESIDUES IN SEQ ID NO: (1)..(691)
MDPLERLSTDGSSLSPEPHSSKQPVRRASKACLACRARKVRCDVTIRSPCGNCQWNGQQCVTHARRARRRRRRPVTTATPCEPGVTEEAATNGGPCNLLEEFAIESHSLDAPMSMDDLELLRADIEADKSPQESPSDIVDAFDLPRYVRPLTSLPPDDMEFLHAEGALSLPDSALQNALLRAFFEYVHPYVPTLDLDAFLHSIETPDGSAGQVSLLLLQAVLAAGTAHVELQHLRNGGYQTRKQARTAFLKRVRLLYKYNCELDQMVLTQSLLLITSWQDASDEHGKTWFWIDAAVSHAFAAGLHLEPSAHKPNLSKRKQRLRRRVWWCCFIRDRLLSLGMRRPPRIKDGDFQVAMLEEADFQPEQIRSDDPDHGRFEAVCVYVKSRKKRAELARMCVAQATLCRSMSFLSSSMYVAPQHDGLLSSEKEAAAAATAAGSGSGSEQKMFTTYIRDLLEWRDGLPEGVSYRPISRSDISRDGSASISLDRAVLHMMYYAAVLCLYRSRFVALLREAEEASAMEKEMCKIYMQHSAKRIGDISRNIYDHGLDRLLPSMAANIAVSAASVHLLELRGQLQGCATEPSYRQSRRLMQSMHDIYAGADLSRESPNWHEEEEEEKREEEEETRSRPGGVVATETGEEEEEEDYLVADGDWLKDLEAATCWYVAEPYRADSFLQYPGEGLDVVNEFFAC

SEQ ID NO: 46 - protein, 839 aa, Aspergillus niger
  ref <308>: DATABASE ACCESSION NUMBER: UniProt A2QCM0
  ref <309>: DATABASE ENTRY DATE: 2007-03-06
  ref <313>: RELEVANT RESIDUES IN SEQ ID NO: (1)..(839)
MGAAKALRLRWTVPPTLLIALGGGLLYSTGPRTQSNKQLLLQTGPKGFFSTSSTPGSDKRSDNSSGSSDWSPLGHGSKEDPHHDAGSIWTNVLQKFEGVKQAVGTPDWIELDNIKNYIIPDWTRLLPLSVQKLQRELSMAPGSLADDIWHEAHDPDINPEILLKAKVRVGDTLCNEELAYRQKRQKYATAALASYLDIPEDDIHPDDVPIIAMCGSGGGLRALVAGTGSYLATQEAGLWDCVTYTAGVSGSCWLQTLYHSSITGRNFNKMVDHLKNRLGVHLAFPPAALKLLTNAPTNKYLLSGLVEKLKGDPGADFGLVDIYGMLLAARLLVPKGELGVCDKDLKLSNQRYNLASGAHPLPIYTAVRHEIPVLENQENAEKREKPEELIKESKSEAWFQWFEFTPYEFFCEELSAGIPTWALGRHFHGGVNVKPEEISPIPELRVPALMGVWGSAFCATLSHYYKEIRPVIKGITGLSGIDSLIQGKTKDLVRVHPIDPATIPNYVLGMKDQLPPSCPESIFQSRHLRLMDAGMSNNLPIYPLLRPGRDVDVIIAFDASADIKQENWLSVVDGYARQRGVKGWPIGAGWPREDEQLKQTEEALRQAQNITQKELANKMAEAQDKSKPSSPTTNRNSTPDSTTTTIPPTKNQTQNKNQNHPSTSTDLDYCNIWVGTTQEMVSGQEPPPSKRLFHPQDTDHSESDFHLMRPDAGIAVVYFPLLPNPSAPELPTSSSLSKSRTPARQSENTSKARVSDPAKPLTPYPGSINPDVDDFLSTWNFVYTPEQIDSVVGLAKANFAQGEDQVKRVVRAVYERKKNDRLRREEREARQRMEGFVPL

SEQ ID NO: 47 - protein, 574 aa, Aspergillus niger
  ref <308>: DATABASE ACCESSION NUMBER: UniProt A2QF54
  ref <309>: DATABASE ENTRY DATE: 2007-03-06
  ref <313>: RELEVANT RESIDUES IN SEQ ID NO: (1)..(574)
MKLLIWGPVLASAAYGRVIGTRTQSKSTLSSPVASVQSPTVYIDTYESTVQGNRSQYISSVYNFKAIPFAAAPTGAYRWRHPQHVSGWTGVRDATEFAPDCPQLGSSYYSEDCLYLNIWTPDTATLNDVQNNTETGIGVVPTSASSKLPVYVWFYGGRFSSGSSSQALYDGAGLAAKGVVVVTVNYRLGALGFLAHPELSQNSSSGTSGNYGLVDQQAALHWTNENIAAFGGDPTRITIGGQSAGAAAVLDHLNSPLADGLFEQVIAESGAIYPSNPLMGSVAEGYRHLAVAEAQGTAYLTSLNLSGIAAARAAPVEVFLAGGDAADVTYENTVFANNSVYMEPPLFRPVLDGYVLPATYQEMLQQGNHTIAAVLTGGNRDENGATPNPGMTVESYTRQNQYEFGSVGLAAEFFRLYPAGNSNSSADAASNTFYQDQTRISLWEWANEYQAGVARNTSGNSTVRTYTYYWTHAPPGQDEGAYHMSEINYAFNNLYATDKPWKPEDYAIADRLSNYWVNFLRSGNPNGPELPDWPANDAAEPVVMEVDDAWEPVLVASAEKRSFMNKWFSNWPVY

SEQ ID NO: 48 - protein, 531 aa, Aspergillus niger
  ref <308>: DATABASE ACCESSION NUMBER: UniProt E2PT22
  ref <309>: DATABASE ENTRY DATE: 2010-11-30
  ref <313>: RELEVANT RESIDUES IN SEQ ID NO: (1)..(531)
MLVYLTNFFIAWLAYFWQPKKQPCGSLTLPHIPGVDIISMTRQEVHNYSVATSPPYNLADVHNLDFCNVSVTLTHPGEDDTVSVSVWLPLNNWNGRFQATGGGGLAAGIIGLAPAHPVSQGYATAATDGGLTLNGTSNPQTGAWILRPDGSINTALLLNFAHRSIYDMTIIGKTLTERFYGSPPRYSYWSGCSTGGRQGYFAAAKYPNLFDGVLAGAPALNFPRLIGYMFWPPVHMFHSAAPPQCVFDTFWKAIIDECDPLDGATDGLISDYNPQSCPFKPETLVGHTVTCPEMGSDSPVTITAQHATLVKQILQGPDLQDHPDLWTGLPPGASFRGTANTQVINGSIVRPVPFFPIIGWIKNFVYRDPDYNVFDMTFDDFNTAYRLTLDGYNGILGSDDLNLSEFRRAGGKLLTWHGLADELIPASWTNAFWEGIDKTDGADVDEFYRVFLAPGLGHCSAGHGPKPVDLLGALVRWVEEGIAPDRLSAAAVKADGKEVTRELCRYPATLVYDGHGDVNDAGSFSLVFVGA

SEQ ID NO: 49 - protein, 774 aa, Trichoderma reesei
  ref <308>: DATABASE ACCESSION NUMBER: UniProt G0RAQ0
  ref <309>: DATABASE ENTRY DATE: 2011-10-19
  ref <313>: RELEVANT RESIDUES IN SEQ ID NO: (1)..(774)
MGLLDRVEAIFGGEGDAERHSHSHSGYQCDELHPEEHVANRYQSFVAPSTGNIKWFVDGCSYFWAVSEALQRAEESIYILDWWLSPELYLRRPPSRNEQYRLDVMLQAAAERGVKVHIIVYKEVEAALTLNSAHTKHALEKLHPNISVFRHPDHAPAGYDIASEIGNSFKNLTNFDLATVSKDTLKAIYGAADDVVLYWAHHEKLLVVDRNLVFMGGLDMCFGRWDTNSHPIADAHPGNVDNTIFPGQDYNNARIFDFADVGNWEQNQLDRTKSSRMGWSDVALSMNGPIVSDLVTHFVDRCFAKLESSCCPWSSGHPTEHSIANAYVGAITNAKHFVYIENQFFITATSDEQRPVSNKIGAAIVDRIVRAYEEGQPFKVWVVMPSVPAFAGDLKSKEALGTRAIMEFQYNSISRGGHSIIQKLVAAGIENPREYIGFYNLRNYDRINTSGTMQQAEYRSGVSYEDARRYHDDYVNEERYGGDDGDSYNYDRYQRQARSVQDDTLDTVSSAYMKDGPNIADIPWDGAPEDEFNAFVSEQLYIHSKLLIADDRVVICGSANLNDRSQLGTHDSEIAVVIEGPRNLESYMNGEQYAASEFAASLRRQIFRKHLGLLPDQRWDRPDQNWLPVTDAPNDYDWGSSADRLVEDPLSPDFLSLWEDTASTNTEVFSRAFHPVPDDHVRTWDDYEEFFSKHFIIPSAKGDDKKSDDGNDDNKVPYGHAVREEFPGGVQELKEWLSRIRGTLINMPLQFLIEVEDIAKEGLTLNGLTDELYT

SEQ ID NO: 50 - protein, 533 aa, Trichoderma citrinoviride
  ref <308>: DATABASE ACCESSION NUMBER: UniProt A0A2T4AZ21
  ref <309>: DATABASE ENTRY DATE: 2018-07-18
  ref <313>: RELEVANT RESIDUES IN SEQ ID NO: (1)..(533)
MLAQSLLVPALLSSVVGAVQETVDVGYSVYKGQALPNGVSQWLGIRYAAPPLGQLRFAPPQDPLRTQGVQDATRHGKYCLGTGRSPTDNSTSEDCLFLDVQAPTKATVLSKLPVFLYIQGGGFNLNSNPNTNASGLIINSGHDIVVVSLNYRVGPYGFMTDSNQIVPNNGLRDQRKVLEWVQTHIAKFGGDPHHVVLGGSSAGAASVTYHLTANNGTNRGLFHAAIAESPSFATTLSVAQSQYMYTQFATRVGCVGRDSLACMRRKTAVELQTSNFNIPLPGAAKPPNYMWLPTLDNEFVQDYTYRVFQQGKFIRMPTIYGDDSNGGTKFAPKDTATLQESNGYVLDQYPVLTLEMLGEINQLYPNPNTSCPAVGCYWRHASNVYQEARYMCPGMYISSVVATHGRDAWVYRWNVEDPEQMASGLGVPHTVELNALWGADYVDGAPASYQEGGTNAAASPTMQHYWLNFIKYYNPNGRSVFDAGKYPLWTKWGFGAQSRLTFQTGGKAEMIPVDAGLKRRCDFWTRNGVALTM

SEQ ID NO: 51 - protein, 609 aa, Trichoderma reesei
  ref <308>: DATABASE ACCESSION NUMBER: UniProt G0RWC3
  ref <309>: DATABASE ENTRY DATE: 2011-10-19
  ref <313>: RELEVANT RESIDUES IN SEQ ID NO: (1)..(609)
MDSYGVRRSDTTKGPPLRILSLDGGGVRGYSMLIIIQELMHRTFVEIEGRAPRRHEIPKPCDHFDLIVGTGTGGLIAIMLGRLRLDLETCKELYVRLTKMVFETDKTIAGIPYRSTLFKASKLEEAIKQGVWEHTVNNKEGNDSDTEVVNPLNARRSGSGSPRRHSSNASTISFSARHPSGQVSSRPTPLRYGNGNARLYDARENRCKTAVTAMYKGSARGTPPVLLRSYDSRKEPPPEFDCKIWQAGRATCSIGLAFKPVQIGQSLFHDDGAGTFNPAPEALDEAVLNEWPGRDVGVFVSVGTGKRPRGSDANQQVWYEGFLGEFAEARRKMIAKIEGCEKIHEYMIREHLAKRGVNVENYFRLNVEVGVGEFGMNEWNRLSDISTGTRRYMSRAEEQKMIHGISTRLAKIHRAKLRWERKISNVPELVQSTSESNFEHTFAVELPGDSPIGPLSHSPHSPASRSSFDSAPDTLHLQANTLSSPRASNDHIRPGTGHSRLGRISPASEKEVVVDLMSPSQYSNKIPYSDDPIAITSPDEEPRYQLPLVPPPLRQATRPEPPPLPPKTPLPDYGHRPRDSETSIPPYPLDDDEGPPPVNMARKPDYLQY

SEQ ID NO: 52 - protein, 633 aa, Aspergillus niger
  ref <308>: DATABASE ACCESSION NUMBER: UniProt A2QII0
  ref <309>: DATABASE ENTRY DATE: 2007-03-06
  ref <313>: RELEVANT RESIDUES IN SEQ ID NO: (1)..(633)
MQCIAALLAFASILSGVSASFNNEYGRHLMQQRALPNAPDGYTPTTVGCSASRPTVRSATALSSNESSWLRTRRNNTLSAMREFFGRVNITDFDAVGYINRISSNTSDLPNIGIAVSGGGYRALMNGAGAIKAFDNRTVNSTSNGQLGGLLQSATYLAGLSGGAWLVGSIYLNNFSTISSLQTYDPGDVWQFQNSIFEGPDGDSIQIIDSATYYRDIYDAVSGKDDAGWQTSITDYWGRALSYQLVNATAGGINYTWSSIALTDSFRRAEMPMPVLVADGRYPDELLVSSNATVYEFNPWEFGTFDPTVHGFVPVQYLGSRFVAGSLPSNESCVRGFDNGGFIMGTSSTLFNQFLLQINTTSLPSFLKDAFTSILEDLGENSQDIAVYTPNPFYLWANSTSPSASQTVLDLVDGGEDLQNIPLHPLIQPERHVDVIFAVDSSADTQYNWPNGTALVATYERSLNSTGIGNGTAFPAIPDQNTFVNEGLNTRPTFFGCNSSNTTGPAPLVVYLPNFPYVTFSNVSTFDPSYSESQRDSIILNGYDVATMGNNSRDGEWSSCVACAVLSRSFERTNTTVPDQCSRCFERYCWDGTTNSSTPGTYEPSTVFDNAGYAVMPAVFATTMAAATVSAFM

SEQ ID NO: 53 - protein, 546 aa, Aspergillus niger
  ref <308>: DATABASE ACCESSION NUMBER: UniProt A2QBG8
  ref <309>: DATABASE ENTRY DATE: 2007-03-06
  ref <313>: RELEVANT RESIDUES IN SEQ ID NO: (1)..(546)
MRLSIRALFPLIMGSRTVHAVLDCDWVAVNAILPQNVSLSFVTAIPENGTFTVPREDTGWPTDPINLPSLCAIGAMVLGETANSSFGFGLFLPTKWNGRTLTVGNGGLAGGVNWVDMVRHGRPAQSSRILTNNLPKQGTGVKYGHAVFSTDTGHNSTATDASWSYQTIESQVNWGWRALHETVIYSKLITEAFYGIKPSFNYYQGCSTGGRQGFKEAEAFPSDFDGIIAGAPAWWTQIWQFWVGYVNYISNLTMIPTSKFDVIGKEVLRQCDGQDGLVDTIISDPLGCNFNPEMLLCSSDVTDTTNAECLTAEQLQTFDILTRDFLETNSTLVFPAWLRGSEHFWNLNIDGGAPNIIGLGYIQYMLGLGPDWKWESFDADIVQLSERLNPGQADASYYDLREFYEGGRKLIHYHGLSDGGIATGASYYLYDQIDRALTPQGIDVNDFYRFFPIPGMGHCVDTANYVNAPYYIAGISMTNNGQHSVPHYQDAKHDVLFALMDWVENGTAPDAIIGTAYANFSTMDAITRQRPICAYPKQAKYRGKGD

SEQ ID NO: 54 - protein, 564 aa, Aspergillus niger
  ref <308>: DATABASE ACCESSION NUMBER: UniProt A2R502
  ref <309>: DATABASE ENTRY DATE: 2007-03-06
  ref <313>: RELEVANT RESIDUES IN SEQ ID NO: (1)..(564)
MKGMLPTLSWLALGMASLATCTNPVAQTKNGSYYGVYMPQYNEDYFLGIPFAKPPLAHLRWANPESLNESWSGLRPATGYAMECIGYGSDQKGYLQSEDCLYLNVVRPAEYDNASLPVLVWIHGGGFAQGGTPDLRYNLTFIVEHSVNIGQPIIAVSVAYRLGPWGFFNGVELANEGSLNLGLKDQRLALHWVKENIAGFGGDPSKVVIYGQSAGSESVGYQIRAYNGRDDGLFRGGMMESGAVLPGSALNLTWTYEPWFQQIADEAGCSQTTRKLDCLRRTPFTVLNNILNTTANDTTPYNWRPTVDGDFVARYPSEQLDTGDFVKVPIIIGYTTDEGTTECPEPVNTTAELKEYLSSTTTYGWALDSQVVSSLLDLYPNTTSFGIPSSEELGGNVTFPQPYGAAFRQTAAYYGDAQFIAATRYTCELWAAHNLTAYCYRFNTKTDDYNREEGVAHFSDVIFIFNNLNGYGFSPNPFTNAPESYTELSYLMSGSWISFTNSLDPNKWTGRGRNATKTENWPVYDLENPLSMIWDANVTSYAAPDTWRKEGIALINANRRAYQR

SEQ ID NO: 55 - protein, 324 aa, Trichoderma reesei
  ref <308>: DATABASE ACCESSION NUMBER: UniProt G0RTR6
  ref <309>: DATABASE ENTRY DATE: 2011-10-19
  ref <313>: RELEVANT RESIDUES IN SEQ ID NO: (1)..(324)
MALLHILITLAPCMVGATCYRGYQSAYSFDAGDSPHPDWMAAIPDDVHLTSLSIPGTHDTMTYGIASQTLQCQNWNLSTQLASGLRYLDIRARVRDDELHIYHANGYTGFSYEQVLLDVFDFLDAHPSEAIIMRVKEEGGPIGTNNSASFEDAFRYHHWASPTTAPGSAKHLHTYDFAAPIPTLGELRSKVFILQNFDARDGGPYGLLWEGPEMVLEDLWVIPDVYHLAEKWTAIRDALEYAALAPDDNRFLYLAHLSASVGVLPIEAAAGPMNRTIQGMNDMTGQYLEDASGNDDLARVGVVIVDFPGRRLIETVLRWNAWLR

SEQ ID NO: 56 - protein, 559 aa, Trichoderma citrinoviride
  ref <308>: DATABASE ACCESSION NUMBER: UniProt A0A2T4BBP9
  ref <309>: DATABASE ENTRY DATE: 2018-07-18
  ref <313>: RELEVANT RESIDUES IN SEQ ID NO: (1)..(559)
MIPPHLIFHLTLTLTLTLLLPLTHAAALPPQNDTCPPQPSTSSSSPPIIDLGYAQYRGIRLHDAAVDTFLGMRYAQPPLSNLRFRAPQDPSPESSIQDASKFGPICIGTGQSPSPSTSEDCLFVNVFKPSRADPTSNLPVWVYIQGGGYSSNGNANYNGTPVVQQSGHGLVFVNFNYRVGALGFLASEHVRRDGHLNAGLLDQRKLLHWVKKHIKQFGGNPNHVVIHGVSAGAGSVTHHLTAYAAKKDTQLFAAAISESPFWPTLRTVSDMEFQYRRVLANANCSSLDCLRRLDTQAFLDAAPVELFPGVNRDAPLPLWYWLPVIDGDLVTDHLYSQFQHGNFIPVPLIVSHDTDEGTYFGANASTLTEAKSFFLSNWPNLQPSQLSAISQAYSPEDLASLPDHAPYFPSTEAAYGDATFICPGNTVAASAAHHFDPRRVWNYRYNVLDPDNVASGLGVPHTFETSAIFGLGSAGQPAASYYTINAAIIPVTMHYFLSFVMKLDPNAAKYASAPHWDPWGQGTGQRLRLETNNTAMEPVPPDQRARCHLWSRLQGYTQL

SEQ ID NO: 57 - protein, 327 aa, Trichoderma reesei
  ref <308>: DATABASE ACCESSION NUMBER: UniProt G0RMN0
  ref <309>: DATABASE ENTRY DATE: 2011-10-19
  ref <313>: RELEVANT RESIDUES IN SEQ ID NO: (1)..(327)
MKLSNAVAFSLVSLPGAMAWGGLGHITTAYIASNFVSNSTEAYLKQLLRSNESDYMAKVASWADSIRYTKWGRFTSTFHFIDAHDNPPESCNVDFERDCKETGCVITALANYTEQSLDPALPAWRRAQAAKFVIHFVGDLHQPLHNEDVSRGGNGIHVKWDGRDYNLHHVWDSSIAEKLIGRGKPYLVAQKWSAALTEKITGGAYADEKETWLADLDFGDFEATAMAWSRECNSLVCEYVFPEGPKAIVGQELSGEYYEKAAPILEKQVARAGYRMAAWLDRIVDEYKKREASYTGELPTDDYAEEPLDEFDLELLDETEKPFVGEL

SEQ ID NO: 58 - protein, 593 aa, Aspergillus niger
  ref <308>: DATABASE ACCESSION NUMBER: UniProt A2QUA5
  ref <309>: DATABASE ENTRY DATE: 2007-03-06
  ref <313>: RELEVANT RESIDUES IN SEQ ID NO: (1)..(593)
MAALDVNGPLPELSEQQPDDLIPESRVLIIMTGGTICMRQSPSGFIPARGFQEQCLARVPTFNDGSHPSMMDVVINSDGEIKGHPALRTPQTAYGRRVRYTVFEFEELLDSSSIDAKGWAQIAHTVERNYTLFDGFVVLHGTDSLAYTCSALSFMLQNLGKPVILTGAQAPMLELQNDATDNLLGSLVVASHFMIPEVCLYFNNRLFRGNRSIKVAASDFAAFDSPNCPPLAVTTSMRTNVNWELVNRPKSLEHFRIQTNLDTTHVACLRIFPGIKPEMVDAVLKLEGLRGLVLETFGAGNAPSGQDNAMTNVLAAAIKRGIVIVNVTQCLTGSVSPVYAPGMSLSRAGVVAGLDLTTEAALTKMSYLLALPDSTPEWVAKKMSVSLRGELTEVSQPVFRHPDGALPERVQSLTVLGYAIAQGDLERVEEIVAREHQWLLNDADYSGNTPIHLAATSPSIEILRYLLLQGGSVHLRNRNGRTPLFLAANAGFSEHVLLLRKSGAHLHSDERTAAQLLARRRPGVWGLAGIGPREVSEREMEELEDSTRREFLSAEIPDQHAGSLGMQAGVMHVGWMEGNPMDDGEPRFELRHC

SEQ ID NO: 59 - protein, 364 aa, Aspergillus niger
  ref <308>: DATABASE ACCESSION NUMBER: Uniprot A2R2M3
  ref <309>: DATABASE ENTRY DATE: 2007-03-06
  ref <313>: RELEVANT RESIDUES IN SEQ ID NO: (1)..(364)
MTRNLAKVRFLLTLVLCVLPRAAIRISAAIFRAFWKGLPLGSSMWNGFAGALITNTPPDQLQAVLPSTLKTYESWVLSRGVSRAVDVLAADNSTRLLWIGPSISAKVLLFFHGGGYVLPLSEAHLDWMAYLRNEAANAGVDMSVCILEYDLIPTNPYPRQLKQAIFAIQRLLVSGYRPSDIVFGGDSAGGHLSLSLMAHLHRHYQSNEVKKNLIHLQSPVKGCFLVSPLSSFDFSTPSYQRWFSADILTRKVVDEWGRYLVNNSPWHEEISAGYGWGMALDVPDSWWDGFTAVDSILVTGGYEEVFSDHIQLLGETLKTKCKGNVALHMSNETHDGPLMDFEARRPPSETTRAIRDFIIACFKD

SEQ ID NO: 60 - protein, 543 aa, Aspergillus niger
  ref <308>: DATABASE ACCESSION NUMBER: UniProt A2R496
  ref <309>: DATABASE ENTRY DATE: 2007-03-06
  ref <313>: RELEVANT RESIDUES IN SEQ ID NO: (1)..(543)
MGNHISYQTSECQIQLPGTTGSVKGLQNGTQSRRFAGIPYAQSPVGDLRWRKPRPYPLQQLPAGQPGDTYDATQFGPVCPQPIYSKAVSSHGGPKHTYHEDCLRLNIWTPVPDPQVCNPKWPVVIWFHGGWFQIGDPSQEPGMDPTELISTAKLNAIFIAVGYRLNVFGFLAGEALREESAGQEVGNYGLWDQRLALEWVYQNIAAFGGDPENITISGRSAGAYAVQAQVLYDFRGEMEDAMRNKFRRLYMHSNAIPSQPKTVEDCQPQFDELCQHFDIPEDLTGAEKLEKLRAISAPDLCDAIMKLKHHTFRPVTDGVFIHPGVFDYYRNGSFAAEFKKRGLRLFIGEVRDENTLYAVTNGPEANVESMKLQVSNYYSPATTDRLLRHYALPDSTDKQEWQSVFGQIIADGQVRAPYRFLVNNLLEHGVELKDVWRYLIAYRMSFITEKVAPASFGVSHSMDRPIWNYSIMHGPSPAERILMDDWIRDLVAFVNDQPDYEYGTRSADEYKVMTPEGTIEVQKDGRWDSLLQLMDVFSGRSEA

SEQ ID NO: 61 - protein, 829 aa, Trichoderma reesei
  ref <308>: DATABASE ACCESSION NUMBER: UniProt G0RLF5
  ref <309>: DATABASE ENTRY DATE: 2011-10-19
  ref <313>: RELEVANT RESIDUES IN SEQ ID NO: (1)..(829)
MDSLRGKLHESKLHDAKAAVSHKKHQIGKFGNLFNREHRHDEEHERRCDRKRTKICASHRFQSYFPEREGNLVKWYVDGRDYFWAVSVALEEAKETIYIADWWLSPELFLRRPPHQKQEYRLDQVLKRKAEQGVKIFVIVYKEVEAALTCNSEHTKHALQALCPEGSPGYNNIQIMRHPDHNVFENAADMTMYWAHHEKFVVIDYAMAFIGGLDLCFGRWDTRCHALSDVHPDEPHAEIWPGQDFNNNRVLDFKKVQDWQDNELSKADYGRMPWHDVSMGVIGPCVYDIAEHFVLRWNFVKRDKYKRDERFDWIILEGREGEDEDLIGVQRPKYPMGDYIRHPLTPLSTKNLLGRGTVHAQVVRSSADWSSGILTDRSIQNAYSEVISKAQHYVYIENQFFITATGEHQSPIHNTIGEAIVEAVVRAGKEGRKFRVIVIIPAVPGFAGDLRDKAASGTRAIMDYQYKSICRGEHSIFERVKAQGVDPTKHIFFFNLRSYDRLNKTPAIAEAEKKTGIGYQQVQRVLAEDIMGEGIHGTADPIEKERDLHMGKANEQEKARNEAVQAKEAFEKAKPKEEVQTSPSVAHHAMAGQGALEDEPWTDPDSEIKNWIQEELYVHAKVLIADDRVVICGSSNLNDRSQQGSHDSELSIVMEDTNLVQTTMDGKPFEAGYHAMTLRRFLWREHLGLLPPQDNDAEGDINAQPPSVEPKNDVYDNDESWKLVEDPLGEELWEMWTSRADKNTELFRHLFHADPDDHIKTFEDYDRYLPPRGVKPGHIFDQFMPPDEAKKKLAQIKGHLVWMPMDFLKDAEMAERGLQVNSWTESVYT

SEQ ID NO: 62 - protein, 550 aa, Sporotrichum thermophile
  ref <308>: DATABASE ACCESSION NUMBER: Uniprot G2Q379
  ref <309>: DATABASE ENTRY DATE: 2011-11-16
  ref <313>: RELEVANT RESIDUES IN SEQ ID NO: (1)..(550)
MRYAAAPIGDLRWRAPLDPIPSDTGTVEKAAAFPPRCLGIGSAYPTDDESEDCLFVNVWAPTNATVKSKLPVWVFIQGGGYVANTNAYWDGAEAVEKSGHNVVMVSFNYRVGLWGFLASERVRDDGVLNVGLLDQRMLLKWVKTHIASFGGDPDHVVIHGASAGAGSVAMHLIAYGGRNDNLFIGGMTESLFFPAQPFVHELEYQFDRVVSQTGCDGVAPDRQMACLRSKDVAVLQAANYAQPFPGRPDPPMPLFYWTPCVDGDLLRDLPYRLFEKGQFISVPVVFGTSNDEGSVFVPDADTPSDVAHFLRNNYPLLTANDTTDILTHYPQLPPVPAHKPWFPTASKAYGEATFICPTNNLLSSYPIRPPQVKSNTTAAKTFPFPSSSSSSPSSPSPSSFPSKRTKKKKSRTEAEAAGAAAALYTYRYNVRDEATVARGLGVPHLSDAPAIFGPGNVPGQEAASYETYNAAVVPLVMGYWLSFVRTLDPNVFRAPGSPRWEPVWQEGGDAGVMRRLLIETEGARMETVDAAERGRCGFWKELGSGRMRQK

SEQ ID NO: 63 - protein, 342 aa, Trichoderma reesei
  ref <308>: DATABASE ACCESSION NUMBER: UniProt G0R9X3
  ref <309>: DATABASE ENTRY DATE: 2011-10-19
  ref <313>: RELEVANT RESIDUES IN SEQ ID NO: (1)..(342)
MLLLLIYATAAASAATASTPGLRKLSNLVTFGDSYTDEGRLNYIFSHNALPPPGELLPVNNATSVGGYAWPRLVAQKTGAKLYDYAVAGGMCSDSVTQHFLSNINGPFPSILDYEVPAFRTDLGYRGLYPDRRPDNTAYALWIGTNDLGIDGFLGDKQVRGATIPDFVECVWKALDGVYRLGGRHFVLLNVLPLQLSPMYASVDNGGTGNNEYWGNKATYNTTETQDRMEQYLSSANSMFATGAPYNLLVKRRWPGATVSLLDVHSLLLDLRADPTRYYTEPVNITGSWRGCGDAGCWQSTNPQSSFVWYDEVHPSERTCEHVADEFIKLLDGRSRYGVTYR

SEQ ID NO: 64 - protein, 243 aa, Aspergillus niger
  ref <308>: DATABASE ACCESSION NUMBER: UniProt A2R088
  ref <309>: DATABASE ENTRY DATE: 2007-03-06
  ref <313>: RELEVANT RESIDUES IN SEQ ID NO: (1)..(243)
MATRAPFIVPALKKHTATVIMAHGLGDSGAGWMALAQNWRRRGMFDEVAFIFPNAPMIPITVNFGMSMPGWYDISKLGRDLDFEEAIRHQDEPGVLRSREYFNTLIKEQIDQGIKPSRIVLGGFSQGGAMSLFAGLTSTEKLGGVFGLSCYLLLHDRIKNFIPRDWPNKQTPFFIAHGEEDEVVKFDFGKQSAKMVQELGVEDVEFHSYSDLGHSADPEEIEDLTKFLQKAIPPEEGQSAAGL

SEQ ID NO: 65 - protein, 535 aa, Aspergillus niger
  ref <308>: DATABASE ACCESSION NUMBER: UniProt A2QZ72
  ref <309>: DATABASE ENTRY DATE: 2007-03-06
  ref <313>: RELEVANT RESIDUES IN SEQ ID NO: (1)..(535)
MDFPRLLLALCFLLTFSLTSAYDAPLVTLDYGTFQGSYDATYNLSYFRKIPFAAPATGENRFRAPQPPLNITNGTYDTDQSFDMCPQRTVNGSEDCLYLGLYSRPWDTSSSTTSRPVLVVFYGGGLSGDALFGMPPNAYPVLNVSTLNDYIVVYTNYRVNAFGFLPGQAIKDSPTSDLNPGLLDQQYALKWVKSHIHRFGGNPNNVTIWGQSAGGGSVVAQILANGRGSNPKLFSKALASSPFWPKTYAYNAPQAEAIYTQLVNLTNCTTASDTLKCLKEVDVQSIRDASLIIDADNTYTTSSYTWAPVIDGTFLIEPLTSATASNTLKTDLIWGMYNAHEGENFIPPGLEDTTTTNGFNSSLASFHNWLTGFLPGLDTSDINLIESKYYPVSGTAETLSYNTTFVRAGLVYRDVVLACPAYWVASAAGEKGYVGEYTIPPARHGSDTEWWDTVSTVQQTDPLIYDGYAGAFASFFQTGDPNAHKLTNGSEPGVPEVQQTAEEFVIATEGFENVGLGELEDRCAFWKSVGKKIPI

SEQ ID NO: 66 - protein, 501 aa, Aspergillus niger
  ref <308>: DATABASE ACCESSION NUMBER: UniProt A5ABH9
  ref <309>: DATABASE ENTRY DATE: 2007-06-12
  ref <313>: RELEVANT RESIDUES IN SEQ ID NO: (1)..(501)
MASPQIQHEGLRAIFTGIERVSEGVTVNEFRGIKYASVPARFERAQPVDGFGDAVVDASSYGPRCPQVDVDVRHLLRIPEDFPIEREPEDEFECLNLDITCPPASSAKGPLPVLLWIYGGSQVVTFCSAASKICDPVKIVADSIKSGQPIIFVSINYRLNIFSFGDGKEKNLAIKDQKLGIEWVRNNIAAFGGDPNNITLAGESAGAVYTHAHLVTGTPVKRAVLASGSLYLSSPLPIEKGQGLINALEAKVQELGEPSLRLASVPALLQALRECNVNTMWIQEDEDFQGWETKSELVDELMIGDTEYESVIWRNGIETFDGEAITAAFEQNEKWGPKLRKMYQVVADRPTACKLGALDLVNDVRYTLPVEVVAEKLQAAGKRVYKYVVDQANPWQASSRAHHAVDLLFLFDGADLSFNPAAQAVGQEMRSRWVQFVNGGSPWSTEQRFAYGPLGSCGEISEAQFASRRRVEHVKVLREAGMGVYMPIVFALTAGKISLLN

SEQ ID NO: 67 - protein, 474 aa, Trichoderma reesei
  ref <308>: DATABASE ACCESSION NUMBER: Uniprot G0RDK5
  ref <309>: DATABASE ENTRY DATE: 2011-10-19
  ref <313>: RELEVANT RESIDUES IN SEQ ID NO: (1)..(474)
MADLTIRNLTITPLELVSVQRFQGEKVRTGNVVANVTGTITSFINATDFSAHRLLPRGDSHDARDVSVHLDPFRAVRTDVRAPDPAGREILRLTFRAGDRRYETDVPSPSRKSAVMKRIDGGDDDDDDEDALDLTVVYVPTGAFLAVFSSAKLHAWMRQLDDAWPLPLLSIPGTHNSPTCHTALPSVRCQSVGVPEQLRNGVRFLDVRVSVSPDSDALPLVHSVFPVSLTGIKYFADMLADIYSFLDANPSETVLMSLKREGAGRGSDHHLSRHLKASYVDRRPDRWWTEPRVPSLGQARGRIVLVRRFALDDHVARESWDGRGWGIDAQHWPDNCEDGTCDGGHVRVQDFYDVTESKNIERKIDYSRGQLERAAEREFHSTATTTTALPIFLNFLSGSNFFNATCWPERIAAKVNPAIVEYLCIRHGEDGKGPKQLKVGAGSTGIVVTDWVGANGDWDLIRCIVGWNARLQLP

SEQ ID NO: 68 - protein, 1635 aa, Trichoderma reesei
  ref <308>: DATABASE ACCESSION NUMBER: Uniprot G0RMI7
  ref <309>: DATABASE ENTRY DATE: 2011-10-19
  ref <313>: RELEVANT RESIDUES IN SEQ ID NO: (1)..(1635)
MEEPDTPTRSRTRFMSKIKAFAASGPQTPKSLNGPTFSSEFGSLSIPNSPTVSRVTTRAPDGLNGEQSDADADVETADEAAIPAAAKKNKRKSRRFKKHSMSGFPNPSRFPSDLDAISTYDRLLRRRASMPDTTQHDHAVSDGEIRGNPRRKPFRRGHSYMSNAMSPPGEDDMEEMENSAVVGRRNGHLRRITVFGGGGLSDGDALTPKRHFFKTDRASSYGAQKWKQVKSTLKLLRQKKEDRFEYYKSAELMAELRAGAPAVLMLASMIQRDEHGNKRIPVLLEQLKLKIKDSKPMPDDDKERHWIFTIELEYGSGPSRMNWCVIRTIRDIYNLHFRYKFALNNDKYMLGKDLGGRPKQPKFPYSAFPYLRGARNKGDESDEDEQASGRGDETGAEMTAAEDAGEGPHSHSRKKSRSNFLGMRRRSTGFTDGGELSVAEGNQGVDTQTRRQRYVEKQRRILEKYLSEMIHWLMFRADSNRLCRFLELSALGVRLAAEGSYHGKEGYLHLQMSKGLDFRHVLTPAKVISRQSRKWFLVRQSYIVCVESPENMNIYDVYLVDTKFSIVSKKKALKRFGSKNKDKNAEDDLNMEPSHEKHHTLKMRTSDRKIRLFSRYQSVMRQFEDSINEMLKQTVWYEKKRFDSFAPVRTGVFAQWLVDGRDYMWNVSRAINMARDVIYIHDWWLSPELYMRRPACISQKWRLDRLLQKKAREGVKVFVIIYRNVEAAVPIDSEYTKFSLLNLHPNIFVQRSPNQFKKNQFFFAHHEKICIVDHDVAFLGGIDLCFGRWDSPQHPIVDDKPTGFEPSEMPKDAEHVQLFPGKDYSNPRVQDFFNLNEPYEEMYDRGKVPRMPWHDISMQVVGQPARDLTRHFVQRWNYLRRGRKPTRPLPFLLPPPDAKFEDLEALGLTGTCEVQMLRSASNWSLGINETEHSIQTAYVHLIEESDHFVYMENQFFITSTEAYGTRIINRIGDALVDRIIRAHQNNEDWRAVILIPLMPGFQNTVDEQEGTSVRLIIMCQYRSICRGEHSIFGRLRAAGIEPEDYISFYSLRQWGMMANDVLVTEQLYIHAKTIIVDDRVALIGSANINERSLLGSRDSEVAAIVRDTDMISSTMAGKPYKVGRFAHTLRMRLMREHLGLDVDEILEQEREEEEMNESAYERDMDAIYEEGAAAADDNSSISSNEAKSPVLPPNNLRLPSFNHDIDLVKLETTSSSSASSVKGKEAETDPRVMNEGHQLDVSGYGPDHWKSAEEAGVDDRLDTVVVDGREMLLHGGKGLAESHQPRQHTAHHEPSDKSGIPPAPLPPASRDGADRADQLGLNPGAPAVPLPVLDDTNIGGPAAHVDPKTGRPTNEPFHPMAADIQPAVINKDCMRDPLDSTFVDEVWNRAARNNTLLYRRVFRCMPDSKVGTWAEYREYMDYNAKFKAMMEGNCAGNENELRREASRQQGAAGDEAVPKQGDQPTIQLPEDEEEEETEKPASGSSNGADPVLRPPPVDGSTDNQSSLEPPSPVYTAGEVPFPALDSSPSKPVSRSKSKDRRANFSTLEKPTSKDTNAAPPPTPSGSAPVKRRRRATTKGSRRGLLIEEMPTRNEAEQLLGLIQGHLVEFPYDWLLTEEHNGNWGYQVDGVAPIAI

SEQ ID NO: 69 - protein, 473 aa, Trichoderma reesei
  ref <308>: DATABASE ACCESSION NUMBER: UniProt G0RVK4
  ref <309>: DATABASE ENTRY DATE: 2011-10-19
  ref <313>: RELEVANT RESIDUES IN SEQ ID NO: (1)..(473)
MKSSISVVLALLGHSAAWSYATKSQYRANIKINARQTYQTMIGGGCSGAFGIACQQFGSSGLSPENQQKVTQILFDENIGGLSIVRNDIGSSPGTTILPTCPATPQDKFDYVWDGSDNCQFNLTKTALKYNPNLYVYADAWSAPGCMKTVGTENLGGQICGVRGTDCKHDWRQAYADYLVQYVRFYKEEGIDISLLGAWNEPDFNPFTYESMLSDGYQAKDFLEVLYPTLKKAFPKVDVSCCDATGARQERNILYELQQAGGERYFDIATWHNYQSNPERPFNAGGKPNIQTEWADGTGPWNSTWDYSGQLAEGLQWALYMHNAFVNSDTSGYTHWWCAQNTNGDNALIRLDRDSYEVSARLWAFAQYFRFARPGSVRIGATSDVENVYVTAYVNKNGTVAIPVINAAHFPYDLTIDLEGIKKRKLSEYLTDNSHNVTLQSRYKVSGSSLKVTVEPRAMKTFWLEPQSTFAVI

SEQ ID NO: 70 - protein, 485 aa, Trichoderma reesei
  ref <308>: DATABASE ACCESSION NUMBER: UniProt G0RRK3
  ref <309>: DATABASE ENTRY DATE: 2011-10-19
  ref <313>: RELEVANT RESIDUES IN SEQ ID NO: (1)..(485)
MAYVVLCLVRGVPLLAHPLPAYTGRFDVGAVDIEVPLDKPRLVTETVFKDSGEPAFEHKTTLFTVYYPVDKGVREHRPRHDWIARPISLTAEGYAKFAGVNNFIVRPIFTFALWLIAGGITIPAKVDVPLLNSTDDDDDVVPEPFPVMVFSHGDASSRTDYTNFVGEMASRGYVVAAVEHRDGSGPGSLMRIHGEPDKKILHFKEAELESVPPMDRAKYKYDQLAFRDAEILHAVAVLRAINDGKGEDVYRRNSRLEGAHLHAWAGRLDLGNLTIGGHSFGATGALQALKHAPSDANPAVGGIIFDPGKESGPLNAVIDVPLLIVHSNTWSKHKSAFYGRPHFDTVKELALGVLRRIPSHASWFLTSIGTSHPSVSDAPLLEPLLLSWTTGSSLDTKEAMKEYVRVADDFWHFLRTSRDTNTGVLAEKVTHEQYGEWVSKERKDEFPKAMAKLWEVHVSPVSDEEESDGGGDGNEKDSIAYRDYL

SEQ ID NO: 71 - protein, 353 aa, Aspergillus niger
  ref <308>: DATABASE ACCESSION NUMBER: UniProt A2RAP4
  ref <309>: DATABASE ENTRY DATE: 2007-03-06
  ref <313>: RELEVANT RESIDUES IN SEQ ID NO: (1)..(353)
MSTTTTTPPLPTLIFIPGAWHQPTCYSKLITHLQTHHPDLHCTTITLPSTTGDPAATFKDDLDATRAAIITETIHHGRNVVLIAHSYGGMVANSAIKGFTSPSSPSSGIIIGLILIASGYTLTGLSFMDPFLGHPPPSWRANHTTGFAELATSPRKLFYHDLPEEEARYWVSQLRPQSLKALFEGGEYSYAGWKDVPSWYIGTGEDKGLPVLMQRVGVGMARGMCPGLRVVYREVEGASHSVFLSRVEVVGGLVWEAVGSFMGREVGGDGDGDNWKSQGVVVPEADVWKVSTWLKFGVPAALGRVVGWGFGLYGWVRVTVHSVCMHIEAHCLYDEIQVIYAIILHRSIRLMFI

SEQ ID NO: 72 - protein, 562 aa, Aspergillus niger
  ref <308>: DATABASE ACCESSION NUMBER: UniProt A2R1N7
  ref <309>: DATABASE ENTRY DATE: 2007-03-06
  ref <313>: RELEVANT RESIDUES IN SEQ ID NO: (1)..(562)
MPRSPSSHRTSFIVRSAFTSPLGTMLHLVCLALLCHVARGLPTQASHNAQPVINLGYARYRGVRLEAGVDEFLGMRYASPPIGDLRFRAPQDPPANQTLQSATEYGPICIGLDEEESPGDISEDCLFINVFKPSTATSQSKLPVWLFIQGGGYAENSNANYNGTQVIQASDDVIVFVTFNYRVGALGFLASEKVRQNGDLNAGLLDQRKALRWVKQYIEQFGGDPDHIVIHGVSAGAGSVAYHLSAYGGKDEGLFIGAIVESSFWPTQRTVSEMEFQFERFVNDTGCSSARDSLECLREQDIATIQKGNTGSPFPGGSSSPLPDWYFLPVTDGSLVPDELYNAFDAGNFIKVPVLVGDDTDEGSNFAYNASSSADVSRFFKNNYPNLTSQQLNEINQVYPRGKLLPRHAAYFGASSAAYGDATFTCPGNHVASSAARYLPNSVWNYRVNIIDESNIAGGIGVPHTFELPAIFGAGSTGTLSSDSSYLTYNAAIIPVTMHYFISFVQTLNPNTYRYATAPEWNTWGNGQRLRLQTNDTAMEAVPESSLQDCAFWKSLTVPMEV

SEQ ID NO: 73 - protein, 448 aa, Trichoderma reesei
  ref <308>: DATABASE ACCESSION NUMBER: UniProt G0RBJ0
  ref <309>: DATABASE ENTRY DATE: 2011-10-19
  ref <313>: RELEVANT RESIDUES IN SEQ ID NO: (1)..(448)
MIFPYYLLAVTLVSATELRHNHRHRSESSLPPSQDPFYAIPANIAAFSPGEIINYREPPSRISAFGWTPTHIHKAYQISYRTTDSHQNATTGILTALIPPNAEYDKILSLQMAEDSATIDCSPSYTMQASSQSSPMLASNTTALQLLFAEAALAQKWIVIVPDHEGPRGSFTASKVTGHTVLDGIRAAKHSNHITGIQRNARIGLWGYSGGAAATQIAITMQGAYAPELNISGVAMGGLSSLAEASDIFGINKGPSAGLIPSAMLGLATQHPELQRAIDEALQPQFRDLFYSPLHQCLQAITVLFFHRDVLGMFRNGSIPGVTAELVKAWKDENNFPQAKIKAPLYIYQSIIDHLSDINRIDAEVRDYCHQGVSVHYERANATNLNHVKYGIVGVYKAISWMQDRLDGKGASRECVTLTDATSTLDPHLAALFPKNISDALFALINAL

SEQ ID NO: 74 - protein, 1214 aa, Aspergillus niger
  ref <308>: DATABASE ACCESSION NUMBER: UniProt A2R689
  ref <309>: DATABASE ENTRY DATE: 2007-03-06
  ref <313>: RELEVANT RESIDUES IN SEQ ID NO: (1)..(1214)
MTRPEDDLAYGQYYQDSARGASSGDSSRGLSDTFKKLKQTYKSHQSQQGSSQQSQQSQQSQSASYYNTSNQTYQSQGPSQSQQYHPQQQQQQQQQQPHPSKPQKQDKFSGLFGKLEELGNEVAQKLGTALDPQAYAEYGAPKPQTENRFGSFAAPRQGNEVKWHVDGCAYFYAVSKALESAKDYIWILDWWLSPELYLRRPPAKHEQYRLDRMLLAAAQRGVRVNIIVYKEVTQALTLSSHHTKHHLEDLHENIAVFRHPDHLPDRQELEASIHTSLQNLSLDAGNLAKMSEDAIKGIYGMHEDVILYWAHHEKLCLIDGRIAFMGGLDMCFGRWDTNQHELADVHGQDLNKIVFPGQDYNNARVSDFHDVAHWEQNQLDRKDTSRMGWSDISVSLHGPVVEDLRKHFVQRWNFIYDSKYQSRNNSRYARLALYGRPTSGPQQQQGPQQGGQAQKPPASPQPGATGPPPPSWQQQAASPQPGANPGPPAPSWQQQAAPSQPSAQAPSSSSSSTPSWQQQQTGVASNTQPSSTANPATPTWQQQAPTPQQGGYAASPSPNPSSQEKPSWQQQPAQPSGYQPQAQTTGSQEKPSWQQQSSEPPAYSAHPQQHYTYSGDSFPPPPPGPPPAQNSVQASYQAYNPQQPSPQNQTPTQGQSQTPYYPPPPNQEVHHSQTRGIHDAHQSGYGDSERGFNPRRLRENFMDYGNVLRGELAGQIHQYQDRFSTHGRQVNQPRGNMTCQIVRSCSKWSNGTPTEHSIQDAYAAVIRNSQHFIYIENQFFITATGDAQKPVENKIGVAIVERILRAARAGEKFKIIVVIPSVPCFAGDLSDESTLGTRAIMEFQYNCINRGGSSIMEMIAKEGFNPMDYIRFYNLRNYDRINVSGPLMQAEQSSGVNYEDARKQHDVTTGGPGGYGPGAPRAAFDTTAPYQQYQQAAQQVGGKSGQWDSVSSCYMLNGPDIRNVPWNGPPEAEIDAFVTEELYVHSKVMIADDRVAIVGSANLNDRSQLGTHDSEIAIVIEDYTPVQSRMNGQPWTASRFATSLRRQLFRKHLGLLPPQDMERPDGNFEPVGVPNTTDFESPESQIVADPLADTLHSMWNTRARTNTEVFRKVFHSVPDDSVRNWATYKEFYGYYFHNADKQAYGEDESRPARYKYGHVVRDDFPPGPEGVRQVKELLSQVKGTLVEMPLMFLIEEDVAKEGLTLNEITEPIYT

SEQ ID NO: 75 - protein, 343 aa, Trichoderma reesei
  ref <308>: DATABASE ACCESSION NUMBER: UniProt G0RCG3
  ref <309>: DATABASE ENTRY DATE: 2011-10-19
  ref <313>: RELEVANT RESIDUES IN SEQ ID NO: (1)..(343)
MKLLSTLASGLVVAFAGLALAQDAATGTISKGPFPADLNGSNFTYPYPVHVFSFASQQQKLQMAFMDVKPTCAPNGQTAVVLHGKNFCGPTWNATIAALAGAGYRVVAPDQVGFCKSSKPDSYQFSTNQLMYNTRGLLNALGVGNVTLVGHSFGGMLATRFALQYPATVDRLVLVDPVGLEDYVEKGVPYTSVDTNIAAEAAQTFDAIKAYEQQVYYVGQWQDSYTVWVTMLNNIYFGSRRAQFIKNQGQIVDLVLTQPVSHYFGDVVTKTLLIVGDQDHVAIGGNWSPPEVAAKLGHFDVLGPQVCGEIPDCTLYQFPDLGHAPQLSAPEQFQKVVLDWLAE

SEQ ID NO: 76 - protein, 576 aa, Trichoderma reesei
  ref <308>: DATABASE ACCESSION NUMBER: UniProt G0RGR3
  ref <309>: DATABASE ENTRY DATE: 2011-10-19
  ref <313>: RELEVANT RESIDUES IN SEQ ID NO: (1)..(576)
MINASEPQASRLSAYLSRLNPVPAFPEYTGPYKVGTIDVEIPVSDLPHPAPRPDNAGDVETVLFRVFYPAVASSAEKLISWLPAPQRHYVSAYTKFMGVGHTLAELLSFLPRHLHYTSIPAHKNATLESATTDNRRWPTMIFSHGLGGSRNSYSYVAGSLASHGVVVFCPEHRDGSAVTSFVRVPGQSGRQSRRIIPYNRISHDVSPEVYEAREAQLRIRLWELGLVHEAILAMDAGQKLNNLNTSTTSLSQFTGRLHVHEPGSIIFAGHSFGATTVYQFLKSTYYADVPEIAAMEKPLFTPAEDSSIRKQVTEKNVTMLLDMWCLPLLAPNSAPLYKLPLPVYADVASAPGGTALLAVESEAFFKWSEHLRATARLLSPDPSSKVVTPAIFERPSGNKLPEPNLFYVASSAHLSQSDFGILFPLLTKKIFNAVEPERALRLNLRAQLQLLRANGVPVARTWIGDLVDGGYVDKLDLAEKKKHSSEHLVTTDDGLDDDKAILDRSGTGLVDHWVWIDTIGLGEEPQEQVGGGESTTDKIEKSEEQMKGELEPGEQAAEIAPTKAISLPQGQGWQAI

SEQ ID NO: 77 - protein, 580 aa, Aspergillus niger
  ref <308>: DATABASE ACCESSION NUMBER: A2QS46
  ref <309>: DATABASE ENTRY DATE: 2007-03-06
  ref <313>: RELEVANT RESIDUES IN SEQ ID NO: (1)..(580)
MHLGKRSYILPLTLLSSITPSYAYNTSLPIVDLGYELHQAFTLDVSFTFTKLLALTYPNLARLSKQSTQAYNFSNIRYAAPPTTTRRFRPPLPPSVNRTEIQTGSVGRVCPQGIPIWSADILVPFVESVLLGTPFNGSDDVSDYPIAWPPADSRITEDCLFLDVVVPKSVFEKPSATAPVLVWFDGGGFAYGDKTEVLPTGLFERGLETGEDFVYVAVNYRLGAFGWLSDGEGMGNAGLHDQRLALEWVKEYISLFGGNPNRVTVMGESAGGGSIVHQLAAYGGNDNRGQGDLPFQQAIIQSPGWYTQSVQQQKSSLRDFLELLNVTSVEEARQLPSDQLITANAYQIATTSIYGTFTYGPVVDNSFITDLPSRLLLDPNFKWKNVRVMTSHATNEGLTFTPPVGMNSSAFQSIIQTYVPGLAPETVDRIAQDWYPPVYNASSSETLGYSSPLERTSTLMSDAFFQCKNLYLDTVFDTSYASVFSVPPGLHAQDVAFNFYDHSQPDAELGIFNESLALTMQDYLLTFVKQGFPSSTEINTTDWEQYAKDGLVMNLGLQDIAITSDPVNSDRCRFWWNITG

SEQ ID NO: 78 - protein, 558 aa, Aspergillus niger
  ref <308>: DATABASE ACCESSION NUMBER: UniProt A2QS22
  ref <309>: DATABASE ENTRY DATE: 2007-03-06
  ref <313>: RELEVANT RESIDUES IN SEQ ID NO: (1)..(558)
MRAVSTIIGVAAAVPLVASAAIQTRSAGSDLPIVNTTLGYVRGTHSPFRGGDTAIVYKGIPFAAAPTGENRWREPQSPQPWSGVLNATEFGPQCAQSYSSAGIFSSGKKTTSEDCLYLNIWTPNYNDTSDITSKNLPVYFWIYGGRFEGGSGDVLTYDGTGLAAKDIIVVTINYRLGPFGFLAHPELSAESGHNSSGNYGILDQQAALRWVHENIANFGGNASQITVGGQSAGSASALDSMWSPLNEGLVAGVISESGARGPHDPMTGSAATSHRTKVAAEAQGIEFLKELNVTSIKELRTTVSMETLLEYDSLSDTIFEGTQFANASAFFMEPPMWRPNIDGYVFPHDYTQSLLLDAHADVPILTGNNKDESGAEPDPGLTASTYNTLYQEVFQNFSEEFFKLYPGDSTSQANNNSNALYRDMSRIGTWQWALAWAEGGAKSPVYTYYFTRSPAENRGEGAYHGSELWYTFNNIPYSDYSNVTWYPYDYEVEEYMSNYWANFIRTGNPNGDGLPHFPPSTETKQTMWLGDSWGAGPISASEERIEFIKSWFATMPEW

SEQ ID NO: 79 - protein, 406 aa, Trichoderma reesei
  ref <308>: DATABASE ACCESSION NUMBER: UniProt G0RMI3
  ref <309>: DATABASE ENTRY DATE: 2011-10-19
  ref <313>: RELEVANT RESIDUES IN SEQ ID NO: (1)..(406)
MGWATLGRFRLLLLIQLAAVFFVEATYIGHQVPLGIKDEPPAVSGISVSLFSSLERLARLVDVSYCLGNSGIRKPFECISRCDEFPNMTLVNTWSTGFLFGDNCGFIAVDQGSEQRRRQSDDGDDKPGAIMVAFRGTYSITNTIVDLSTLAQKYVPYPSPDHGGESPEKPSHECTNCTVHMGFLQSWQSARKAVLPELKALRAQYPSYAIHLVGHSLGGAVACLAALELKVSLGWDDVTVTTFGEPRAGNAQFARFVDDVFDLDGIIDLETRSYRRVTHADDPVPLLPPGEFGYTSHGGEIFISKPALSPSETDVQLCIGDADPNCSAKDDSSVEGLLYRLLHFRWTTSSLEEYTQRMSFPARFKLWQLFFAHRDYFWRLGLCVPGGDPSNWGRLPYSYEPREEEL

SEQ ID NO: 80 - protein, 817 aa, Aspergillus niger
  ref <308>: DATABASE ACCESSION NUMBER: UniProt A2QMI7
  ref <309>: DATABASE ENTRY DATE: 2007-03-06
  ref <313>: RELEVANT RESIDUES IN SEQ ID NO: (1)..(817)
MDKFKHKIENLEEQLKETHIEEKAFHLKHKVGKFFNIVNPNHRHDEAHEKATDAKRTAISESHRFKSFAPIREGNKVKWYVDALDYMWAVSMALEEAKETIYIADWWLSPELFLRRPPFMAQEWRLDQVLKRRAEAGVKIYVIVYKEVRSALTCNSAHTKHALRNLCPEGSPGYGNIRVLRHPDHNIFENAADMTLYWAHHEKFIVIDYALAFIGGIDLCFGRWDAHQHPLADVHPSNLRNEVFPGQEFNNNRIMDFQSVGDWQANELSKAEYGRMPWHDVAMGVMGDCVYDIAEHFVLRWNFIKRDKYKRDNSVDWLMLEGRTGDDEDLVAQGFARAQIVRSSADWSSGILTEHSIQNAYKEIISQAQHYVYIENQFFITATGDKQAPILNTIGQSIVEAVVRAGKEGRKFRVIIVIPAIPGFAGDLRQNEATGTRAIMDYQYKSILRGEHSIFGQIAAQGVNPRAHTTMLNGGNMSDEPWEGDPEAEKENFIQEELYVHGKVCIVDDRVVICGSANINDRSQLGYHDSELAIVVEDEDLIGSIMDGKPYKAARVAATLRRQLWREHLGLLPAQHYDASEDPNAKPPYMCMNHILEGPEDDFVTDPMSDELWEMWTGRATVNTDMYRMLFRADPDDNIRTFDDYDKFCPRGNKQGHLFDPYQPVEEIREKLDKIKGHLVWMPLEFLKDANMAEPGLAVNQITEVILPTSRYFAQLNPTSRDPRIVGKVHTATPTSMSQVPSELDNISKVEEFLNSKVQGMFYPDTTPPSLSLSLPAHRPISQFVVSYLIAPFMYTILVITMKTNRSMWILTSYYLP

SEQ ID NO: 81 - protein, 624 aa, Trichoderma reesei
  ref <308>: DATABASE ACCESSION NUMBER: UniProt G0RVN2
  ref <309>: DATABASE ENTRY DATE: 2011-10-19
  ref <313>: RELEVANT RESIDUES IN SEQ ID NO: (1)..(624)
MSPSAAVLIPLAAAVLLRPVVGQTQCGGNLYTPGTLNFTLECYNAFQDCVAQFEANASQVDCNDGKGNLFMQQQANLGASPGSQNNDAIIAFQDIRDLCLLSGSTTATWGYSDNQWYWAAAEDACYTNDPTRTDVVKTHPAPFCIQNRDSSLPECYPQPDATPPGGPLKVIKTAKTRNGFKSSARGWNTYGVQALVNGSQVVPSFAGQSGLFYTQKFVETQCGVLARPEFKKAGYDLCSLDSGWQATTAVDQHGRIIYNTTRFNLPELASWLHKRDLKLGVYITPGVPCLAHNQTILGTNIKIKDVLNGNNDQINCDFDFRKDGVQQWHDSVVAQWASWGVDMLKLDFLTPGSPSNGANLACDSSDAVRAYQKAIKKSGRKIRLDISWKLCRNETWLPIWSDLAESMRTDQDLDNYGTNTLMAWQVGQRAIENYRQYIGLQAQRNVPLTIYPDMDALFTVNPEHLAGVNDTIRYTVQNHWLGAGANLIIGGDMEQVDALGLKLTTSKQSIDAADFFAKYPMQPRNPGTGSNAAKQLQAWIGGPSDDHEAYVLIVNYGPDLGNGGFSTKLYGKQKVTVSLKDLGISGSAWTFTDIWSGKSSRVTGSYSAWLTEGESQLLRLKRTH

SEQ ID NO: 82 - protein, 398 aa, Aspergillus niger
  ref <308>: DATABASE ACCESSION NUMBER: Uniprot A2QT70
  ref <309>: DATABASE ENTRY DATE: 2007-03-06
  ref <313>: RELEVANT RESIDUES IN SEQ ID NO: (1)..(398)
MLMQSLSTLIINTAKMIRLLLHTVIFLFVGLSRAAIVPLPPGTGPCDVTLQASELVDQARTNPFDLKGGKRALMVTTFTPVNCGSVLSESYIPNATAAYEDESFQSLGLAAGTFESFRIQTQQQPSPSSINGSYPIVLFSPALGTSRLVYTSLLQDIASYGFAVISVDHPYDANIVEFPDGRTVIGVLENTTTDAQFTWAMNVRVQDMIFVYNQTRNETAVGDIFPLSLENPHLLSLDRVAITGHSLGGATAAQTMLVDNRFVGGINLDGTFWGSVLTKGLSSPFLLFSNANHTAATDPSWGTFWSNLRGWRLELRLAQSKHYTFSDFPVLLDSLSISDELKEIVQASYIGTIGALRAKNVIVSYIVAALQYFAYGRTSDLLSGPSAAYPDVTFVHSA

SEQ ID NO: 83 - protein, 767 aa, Aspergillus niger
  ref <308>: DATABASE ACCESSION NUMBER: UniProt A2QCT1
  ref <309>: DATABASE ENTRY DATE: 2007-03-06
  ref <313>: RELEVANT RESIDUES IN SEQ ID NO: (1)..(767)
MIDHVLGRPSTKFRKIQVLAVLVFWSTYLLRGNKNGPPFIRKISSRLSKKLSVWQTTVLVFLWLYICRNFAKIVGLECPEPLANLYSRSFFRATWITTGLDAGFWTAMGIKPKWLRDIASLVFSGYYLIAAEQADEKVRRVRATLTVEHMRVSWNKSTTPYLWALAKLGRPRLTKYPPRAIRIPRPASSIYKEPTNAWLYFDGSLAALRDQTCIVLDIPGGGFVSMSPRHSEDRLLAWAARTKVPVLSLDYKKAPEYPYPYALNECYDVYHSIVSTRGRCLGLNGRTRPRVVITGDSAGGNLATGVTLMILQSGSTHASRWQGQNMLPPPDGLVLPYPALNMKIESWMTEEQMALIQEKSTRRTNESVLRRKDMDYHRLTPFTSPGTSFGDFQRDSFSDADLEVGNLVDATSEKLAQQQKMDVTEEEVAAITEHQPKQIRTRLAVSSMISYVNDRILTPEMMRAMIILYIGPHNRPDFNTDYLLSPALAPEELLARFPKTYIITGERDPLVDDTVIFAGRLRQAKLRQFQERQELGLEKSYRRFNAKDHVEVSLLPGISHGFMQMAGFFPDSWKHIYRCATWIQDLFDLAQTKKSSSGHLRALTNGAQMPKGPKSVPRGNSSRNHRRRLTGESSGDEDRPLEIGIKKLTPLTPLHRSSSAPIDSTEIDSQDIAAKDGDSEDAKKERIRSVSRGRTLRPGITRKQRPIPMRLTIPPRDGYISGSPSPIPLRERNRSINSLASEEDLLDRRMNGLAGGLMGIGEGARTP

SEQ ID NO: 84 - protein, 505 aa, Aspergillus niger
  ref <308>: DATABASE ACCESSION NUMBER: UniProt A2QUC1
  ref <309>: DATABASE ENTRY DATE: 2007-03-06
  ref <313>: RELEVANT RESIDUES IN SEQ ID NO: (1)..(505)
MASSVFLPLLAASLLPTLASTQNADTPTSAPTVQVRNGTYEGLYNPTYNQDLFLGIPYAQPPVGELRFRPPQPLNTTWTGTRNATAYYNECIGYGSDDWYWTDVVSEDCLALSVIRPHGIDSSAKLPVVFWMHGGEFAEGGTRDSRYNLSYIVQQSQEMQSPIIGVTVNYRLSGWGFLYSQEVADEGSANLGLRDQRHALYWLQENIASFGGDPSRLTIWGQSAGANSVGLHLVAYDGQNDGIFRAGIAESGSVPSLAAYMSAEDAQPYYDAVVNATNCTGSSNTLTCLREVPTDVLSSIFNSSLVAGAGYHPVIDGDFLRASGIVNLQTGQFAKTPLLIGTNFDEGTKYAPHGYNTTDQFVSLVQANGTNYTSALTIASLYPDDPAVGIPGTLQGRPPPSYGYQWKRVAAFLGDLLMHAPRRVTTQWLAHWNVPAYVYHWNVMTLGPLDGAAHGYEVPFSFHNYDGLGDERGNDSVTWPQLSTMMSRMWVSFINHLDPNYSNSE

SEQ ID NO: 85 - protein, 548 aa, Trichoderma reesei
  ref <308>: DATABASE ACCESSION NUMBER: UniProt G0R707
  ref <309>: DATABASE ENTRY DATE: 2011-10-19
  ref <313>: RELEVANT RESIDUES IN SEQ ID NO: (1)..(548)
MMGLVLAVWRVLVDVAAFWHKKLLSWYTRKNPVTLWLELLRNAETFEDWEEAALHLDNLLGLDLWRNNPTSKYYDWALIAERLDSLVVAREENNYEQLVNLLRSGLVRNLGNIAVPKLYNRSFSGTKYLIEEYIAQVAESVEDISALPTSPTSSLHHHPNDKALTNQMKLDFIHDTRQAFGRTTLVLQGGAIFGLCHLGVVKALFLRGLLPRIITGTATGALIAALVAIHTEDELPAVLRGDGIDLSAFAWETLIRRVRRFSREGYFLDVTVLEDCVRANVGDLTFEEAYHRSKRVLNITVATDGQGAGVPTLLNYITAPNVLIWTAAVASNASSPSLYGRSKATILCKDAHGNIVPWAPANTTDFRHWTHASYTDRDSPLRRIAELFNVNHFIVSQARPYLIPFLQSDMHGPSLVETRSKSTQLSAFLVRMVGLEIRHRLRQLDSLRLVPASIRRFLVDEQVPAASMTLVPEVTAGDFIRLLETPTRDTLNYWILRGERSVWPAVAALRIRCAVENELDRSYQVVRKLKAGDLRRKGSMAAFADNGR

SEQ ID NO: 86 - protein, 231 aa, Aspergillus niger
  ref <308>: DATABASE ACCESSION NUMBER: UniProt A2QT47
  ref <309>: DATABASE ENTRY DATE: 2007-03-06
  ref <313>: RELEVANT RESIDUES IN SEQ ID NO: (1)..(231)
MFRNIVTAALLSFALASASTAHTNGQAPCAKVHMMLARGTTESYPGLLGSLTELVVDAVPDSDYENIIYPATQEGSTPSYEEGIYNGTTQLKAYVKACPESKVVLFGYSQGAMVVSDMLAGGGDNGTLGNITAPAVDPETGSHIAAVLLYGDPRHMPNQTYNVGDVTATGKYPRTPEQLAALSQYADRLHDYCDDKDGVCDAAGTNLSAHLAYATIWDKVAATWVESMMQK

SEQ ID NO: 87 - protein, 213 aa, Trichoderma reesei
  ref <308>: DATABASE ACCESSION NUMBER: UniProt G0R6X2
  ref <309>: DATABASE ENTRY DATE: 2011-10-19
  ref <313>: RELEVANT RESIDUES IN SEQ ID NO: (1)..(213)
MDLEKRQCPGIHVFGARETTAPPGYGSSATVVNLIINAHPGTTAEAINYPACGGQAQCGGISYANSVVAGINAVVQAVTNFHNRCPSTKLVLVGYSQGGQIMDDALCGGGDPAEGYPNTAVPLPAAAVSAIRAAIFMGDPRYVHGLAYNVGSCQAQGFAPRNVGFVCPSGNKIKSYCDASDPYCCNGNNANTHQGYGQEYGQQALAFVNSLLG

SEQ ID NO: 88 - protein, 271 aa, Aspergillus niger
  ref <308>: DATABASE ACCESSION NUMBER: UniProt A2QPJ6
  ref <309>: DATABASE ENTRY DATE: 2007-03-06
  ref <313>: RELEVANT RESIDUES IN SEQ ID NO: (1)..(271)
MLIQESFHDVPTKADGNGTMRIYVFHPTIPGYPKARFPGVVVFSEIYQVTGPVARFARQIAGQGYICAAPSSYHEFTGPEPLKYDAEDTDKGNQWKISKKIAAYDEDASLCVDYLLSLPTCNGRVGATGMCLGGHLAYRCALDSRVKAAVCYFATDIHSKTLGLGKNDDSLARAGDIKGEMLMIFGKNDTHVPPEGRDLIRKTLHDKGVLFGFYEVAWAQHAFIRDELSKGRYDPAITKVCFEMLLELFGRTLKLDLGEHDGKELKIEDVC

SEQ ID NO: 89 - protein, 254 aa, Aspergillus niger
  ref <308>: DATABASE ACCESSION NUMBER: UniProt A2R032
  ref <309>: DATABASE ENTRY DATE: 2007-03-06
  ref <313>: RELEVANT RESIDUES IN SEQ ID NO: (1)..(254)
MTTEKPSIVLIQGSFQTPLVYAKLTTGLRDLGYPLIHPSLPSCTDVEADDFPTRTMEDDARTVTETLQQLIEKEGTSVVVVMHSYGGIVGSTAIPQSLAYTSRQAEGKKGGVLHLFYYAAFVLPEGASVMGTFGESPNNYVTSDGRFRITNGAEILYSDLPDAEAALWESRLIPQSHLVQTTPTTRAAYEYLPSTYLICEGDQAAPVAFQGGFAKLARAEIDRCSAGHSPMLSQPEMLVGKIAAVVEKAVAAST

SEQ ID NO: 90 - protein, 556 aa, Aspergillus niger
  ref <308>: DATABASE ACCESSION NUMBER: UniProt A2R273
  ref <309>: DATABASE ENTRY DATE: 2007-03-06
  ref <313>: RELEVANT RESIDUES IN SEQ ID NO: (1)..(556)
MLRNTLPTLLGLASFSSAALYETKIETKYGSVQGYPAFNSSHTGNLTHWKDITVWKGIPFAATTGGANRWKAPQPASPWNGTLDARNWGPVCPSATTGDNSYTIDEDCLNLNIWSPANSTDAKLPVVMWSYPAESTAADPLFDGGGMADKGIVFVNYNYRTGPFGWLAHSELSEEFEKVTGSNSSGNWGMLDQFAALKWIHANIEAFGGDPDQITVQGQSAGSAATQHILYSNLTKGLIVGAIIESGVRDPHDPLCTSLAEAYTTLDDALEDGNTYLSNLGVSSIAEARNLSMEALIDGATGSTREDTIMFEAVLDYYAMPDTYLNILKKGLAHDVPVITGNNKDENGATYGLDISLAEYLEDLNETYSGEWVERFFDLYPANDSTTASGAYNSMFTDRSKVGTWLWTQMWYTKKSSLVWNYFWDHAPPGQSSGAYHESEINYVLNNLYATDKPWTAEDYAIAKNMNDYWASFIKTRNPNTQAGGAVHWPAVNSSKLVQHVGDGWGQIPIAWSKKVKLFENWFATLVAYWILSGMSIRVLRDPVTWDHQVDAFARM

SEQ ID NO: 91 - protein, 347 aa, Trichoderma reesei
  ref <308>: DATABASE ACCESSION NUMBER: UniProt G0RBB4
  ref <309>: DATABASE ENTRY DATE: 2011-10-19
  ref <313>: RELEVANT RESIDUES IN SEQ ID NO: (1)..(347)
MLQNVLWPTITGDLKWPDTTPPTVTVVPPQWLPSRDASPRLRATWLGHACYYVEFPSGLRVLFDPVFEDRCSPFSFMGPKRFTPKPCDLKDIPVVDAVVISHSHYDHLSHGSVLEIQKHHPQAQFFVGLGLEPWFRRNGLKNVTELDWWEDAELTVTVNTNDGDGDGNNGSGEKKKKKTISAQISCLPAQHTSARSAFDKDTTLWCSWGVRSGDKNVWFGGDTGYRAVPRVPAGVDDYGPEYEALPRCPQFKHIGQHRGPFDLGLIPIGAYFPRVAFSAMHANPFDSVEIFQDTRCRRAMGIHWGTWALTMEDVLEPPRQLREALRRKGIPEEGVFDVCDIGQSREF

SEQ ID NO: 92 - protein, 338 aa, Aspergillus niger
  ref <308>: DATABASE ACCESSION NUMBER: UniProt A2QS21
  ref <309>: DATABASE ENTRY DATE: 2007-03-06
  ref <313>: RELEVANT RESIDUES IN SEQ ID NO: (1)..(338)
MKLAMTIIRELGYAQSLSLEPDKLGSQWVLMNPAPEDSYRGAFTSDTIKPETIGGTWYPSPPSKSLPPFIDIDNDQEQEVDDEKSLVILSFHGSAFLWLTGRPDDSGFTADLLNEKLGTGTRSLWVQYRLAGGNNPTPYPGPMQDAVTSYLYLVRELNISPSRIVLVGDSSGATMAMALLRHLASFQQESGHELAELPPPRACLLFSPSVEYSFEGDSQAMNAHRNLRTDYCEGKMAAWGARAFAPPESVRLDDPYLSPALHPFATPVPIFAQVGGAEVLCDSVRGFADAMGAVPGNIVEYLEVPGLPHDIYMMGHILGWQEEQEEMIEAAARFVRGV

SEQ ID NO: 93 - protein, 299 aa, Trichoderma reesei
  ref <308>: DATABASE ACCESSION NUMBER: UniProt G0R8N5
  ref <309>: DATABASE ENTRY DATE: 2011-10-19
  ref <313>: RELEVANT RESIDUES IN SEQ ID NO: (1)..(299)
MRALSLSLPLSLSLLAASSTAATTCAKGLYMVVARGSEEPAGTGVTGNLTSQIAAKVPGSEVVAVDYPASFDDYEDSEGDGVKAMRQLLNSYAEACPGNKIAVLGYSQGAQVATDTICGGAGDPFTSDKGMSDDVMDDVVAVAIFGDPTHVANMTYDRGTSIHNGLFNRSSSSIEVCKSYASRIVSYCDTGDIYCDAGSNSTVHHMYIQRYGDEIVDFVVSQFEKSTSSGSGSGTNATTTTAPAPTVSPTTTSGGNSTVPTRTGGPTTSSTQGSGASALTSSLMLGGLLTVLTAVSQML

SEQ ID NO: 94 - protein, 292 aa, Aspergillus niger
  ref <308>: DATABASE ACCESSION NUMBER: UniProt A2QSJ9
  ref <309>: DATABASE ENTRY DATE: 2007-03-06
  ref <313>: RELEVANT RESIDUES IN SEQ ID NO: (1)..(292)
MTSYPPRKCCFQGVKHEGDATGDFITIDDFEVYKKAPEGAAPEKAIILLTDILGHRFKNAQLIADQFAANGYLVLIPDLFYGDPIPIGGSAGLDLHKWLVGEYHEKKIAHTPPVIDPILEKCITELRTKYNIKKIGAIGYCFGAKYVVRFLKPDQGKVDVGFLAHPSLVEKEELEAIKGPLAIAAAEKDHVFPAEKRHESEQILETLALPYALTLYGGVGHGFALRGDLSDPKVLFAKENAFIQALQWFDEHLTVMNVHEIRPHLSVSYSGIHSPTGLRSMTFNPGFNTSPN

SEQ ID NO: 95 - protein, 582 aa, Aspergillus niger
  ref <308>: DATABASE ACCESSION NUMBER: UniProt A2R9C0
  ref <309>: DATABASE ENTRY DATE: 2007-03-06
  ref <313>: RELEVANT RESIDUES IN SEQ ID NO: (1)..(582)
MRSKMSLLAGTAALSFAQATSLADVCTSSYARSVAPSSPLMGVTVDTTSITANPVYNYSSASTAFWPASTFDFCNVTLAYTHDGLDDQVLLQFWLPAPADFKNRWLSTGGFGYAINGDSADLPGGVMYAAASGQTDGGFGSFSTEFDAVFLKANGTIDRQALYMFGYQAHYELSAVGKAFTKNFFNLGSSKLYSYYQGCSEGGREGWSQVQRFGEEWDGAVIGAPAIRYGQQQPNHLYPGLVEYTMGYYPPPCELEKINNLTIAACDALDGKKDGVVARTDLCKLHFNVNSTIGAPYYCPAETTTTVLKKRLSTSNTTPAQNGTVTKEGAAVAAKILDGLKTLDGKRAYIWYQPSATFDDAETEYNSDTDSWELDITSLGGEWVAKFLELRDVDNLSTLDNVTYDVMTNWMSLGWQRYEDVLQTTWPDLTPFHSNGGKIIHVHGESDPSIPTGSSVHYHESVRKTMYSSLSFNESSDALNDWNRLYLVPGAAHCSYSTDQPNGGWPQSTLPTLFDWVENGQKPDRLNATVQEGENYGQVQQLCAWPLRPYYVNNGTELTCVFDEESYQTWVYDFDAYELPLY

SEQ ID NO: 96 - protein, 539 aa, Aspergillus niger
  ref <308>: DATABASE ACCESSION NUMBER: UniProt A2QBH3
  ref <309>: DATABASE ENTRY DATE: 2007-03-06
  ref <313>: RELEVANT RESIDUES IN SEQ ID NO: (1)..(539)
MGNHISYERTPHDIDLGNLGRIRGLQFDNKARRYARIPYALPPTGAYRWRKPRPLPLDYSYSGPDGIPLDATMFGPVCPQASFSSSAEKASSPDVYSEDCLLLNIWTPVTMPPPGKRWPVVLWLHGGWFAMGDPLQEPGMDATELISTAGLQAIVVGIGYRLNIFGFLAGETLLAANEDGDAGAGNFGLWDQRIALEWVHAHIHRFGGDPDNITLGGRSAGAYGVHAQLLYHCQHDANERRLFRRIYMYSNAIPGQPKTLAEAQPQFDEVCRYFKLDPTLSPQEKLEQLRQVDAADLLAAMGFLQHHTFRPVTDGDFIQPGFNAYHRSGELAARFHARDLRLLIGEVLNEETLYATYNSPEASLVSLRNQLANYYAPRIVDRVLAHYSLPAADSPVAAWKALFGTIVADGQVRAPSRYLIHCLATHGVPLTRIWRYQIAYRLSFITETVAPLSFCVAHAMDKPFWNYSIMHDPTAAERELMNEWIKILVSFVHDENTYEFGTQSLDEFKVATPQGMVQVKRDPRWQELVKLGEVFSDDV

SEQ ID NO: 97 - protein, 541 aa, Trichoderma reesei
  ref <308>: DATABASE ACCESSION NUMBER: UniProt G0RJY0
  ref <309>: DATABASE ENTRY DATE: 2011-10-19
  ref <313>: RELEVANT RESIDUES IN SEQ ID NO: (1)..(541)
PVLPSHPDTVHPAEHTFTLRHIYHHGTDRNPRLHRKLDVVHDQSRVFLAADDEYAEHTVPQLKARSRAETIERLADRRPSVVDPIVAESRRQGYAAVLDASAWTMDDVSSPDITDKETVLTMAYVAADAYVENEGQADWQDIGAPFNRSLDFGWGTDGLRGHIWADENNSTVIIGLKGTSPAVFDGEGTTTNDKVNDNLFFSCCCAQQGQWTWHQVCDCATGTYTCNNTCVRTALREENRYYAAARELYSNVTEQYPDSNIWLAGHSLGGAVSSFLALTYGVPAVTFEAVPEALPASRLGLPVPPGADPDAPQSRAYTGTYHFGHTADPVYIGTCNGATATCSFAGYAMESSCHTGYECVYDVVADKGWRVGIGTHKIRSVIQDVILKYDEVPKCARTPECRDCGPWKMYESNGTETTTSAVPTTTTRTRTRTSTCQTPGWWGCLDQPTTTGDTKVPAPTPTVTTTTSTCKTPGWFGCKDKTTTPASTSQSSTTTTTCETPGRFWGCNDEATPTSSVFTTVPASTTCETPGRFWGCKDAVT

SEQ ID NO: 98 - protein, 452 aa, Aspergillus niger
  ref <308>: DATABASE ACCESSION NUMBER: UniProt A2QZE3
  ref <309>: DATABASE ENTRY DATE: 2007-03-06
  ref <313>: RELEVANT RESIDUES IN SEQ ID NO: (1)..(448)
AQZEMFLLDVLQTILLFKAQLLSQFAPSGRGPTGGAFDCSVDDIKSLLPDGSKLLYASHYDADDRFTPPLEHNSGAFRISSYTLPRSACVFQANLTLPGETEHSVGVVLPDDWNGRFLTAGNGGFSGSVSWGSIIDASWYGFAAVSTNTGHESSGAEWAYHNQEALANWGYRAMHDAVVNGKSVTEQYYGKKIAYSYYRGCSAGGKQGLKEVEMFPYDFDGVIAGAPAWWTTHLQLWNMIVGIWNSPADSPHHLSNEHIDLLANEVIRQCDPQDGVEDGIVMNPDACIFRPEALLCVEDVTDLSNCLNTEQIKTVYKLHNDWMEANDTFIFPHLTLSSEWKWSGLVSSPASLGTDYVKWMLQLGEDWSWEDWDPELIKLSDELNPGNATTDDYDLSPFYNKGGKLLHYHGWSDWSIAAGSSIYFYDQVVNALRPKGINPGDFYRFYLIPGMG

SEQ ID NO: 99 - protein, 1150 aa, Aspergillus niger
  ref <308>: DATABASE ACCESSION NUMBER: UniProt A2QW83
  ref <309>: DATABASE ENTRY DATE: 2007-03-06
  ref <313>: RELEVANT RESIDUES IN SEQ ID NO: (1)..(1150)
MEADWDELSRIPVPAPSVHALPTIATAIAFDDVMELLWGRITSFFGPELQRYTSVRAHPATEPVRQIIFHDRGVISLSPKSVHMITRRGLTQWHIAHEEMTDLRCMSFTAQTNRIIVAGCQKSMFTIDIDKGIIIDKLHTEYNYTIMKKSRYLCAATDTGSVNALSLNDFSVVKSWKAHGTAVNDMDARNDLLVTCGFSVRHLGSPIVDPLANVYDLKTLSPLPPIPFHAGAAYVRMHPKLHTTSFVASQTGQLQVVDLMNPNAINLRQANVSFMLGIDLSPSGEALAINDAECAIHLWGSPAKVHFNEMSKEAEFGDVAPRPPTLDWSPETPLSMIGMPYYHERLFSAWPSHLVFEVGSPPPQVDQALIPYLRPAELGHHAPNPKKTRRYQVENTRALASAEPALIAPKFLSEKAREQNKAKSEGAISDAAEALAGAKINGETDDDPLLKYSNVEIKYSRFGVDDFDFRFYNQTTFSGLETHIANSFTNALLQLFKFIPYIRNVALHHAASSCIFETCLLCEMGYLFDMLEKASGQNCQATNLLKTFSSYREASNLGLFEENLTNKSLSAAIQAVNRFFLGQISHDFRMISPSSDDLDHRLATVASESIRCMFCQNEIVRPGNSLVNELNYPAIDIKQARRNPAFRFSNILRASIEREAQNRGWCNYCRRYQQVAIRKSVHRMPQVLMLNAALTNPICRRLWAIPGWLPEEVGIVIEGGQILCFEGEDLKLRVQAKMPGLVVYDLVGLVCEIDIPEHQKAHLVSFINVSISSREPETKNKWHLFNDFLVTEVDKEEALRFNQPWKIPCVLAYQVQDGRHAMDDTWKDALDTTLLFRDWSLNGGRPVESRVTLSEEEKPTPGTPVALDTEFVDLEKAEIDVKADGSQEIVRPSKSGLARVSVLRGSGIREGVPFIDDYITIKENIVDYVTQYSGIKPGDLDPRVSQHNLVPLKVAYKKLWLLLNLGCVFVGHGLASDFRKVNIQVPKSQTVDTQYLFFHPGKNRRLSLRYLAWAVFKEYIQEEPADDSQGHDSIEDARMALRLWKKFKEYEDAGIVSQILEEIFREGSKLGFRPPPRNGVPTVLSRPGTAVTMQNNSGRNTPSTSDVAGAAASAPATPRQAFRRSIALTPSNGSFAGPGTGDFFSGSPLK

SEQ ID NO: 100 - protein, 534 aa, Aspergillus niger
  ref <308>: DATABASE ACCESSION NUMBER: UniProt A2QST4
  ref <309>: DATABASE ENTRY DATE: 2007-03-06
  ref <313>: RELEVANT RESIDUES IN SEQ ID NO: (1)..(534)
MHWEYSLVILLGACAVSVDGSPQVDLGYARYRGVRLPAGVDEYLGMRYAAPPLGQQRFRAPGDPSSTSSIQDAFEFGPTCIGVGEEISPLVGEDCLFINVFTPSHATTLSRLPVWVHIQGGGYASNANANFNGTNVIQHSGYDLVFVNFNYRVGALGFLASEEIRRDGDLNVGLLDQRKALAWVKQHISQFGGDPDHIIAHGDSAGAGSVTHHMTAYGGRAEGLFAGAVLESPFWPTLRTVAEMEFQYTRFVQRVGCSDASSALACLQSADLAAIQQGNVVDPFPDAAVDPPPLWYFLPVIDGAVVQDQLSRLFDQGKTVKIPVLVGDDTNEGSTFAYNASDASDMSRFLNANYPGLSSASLAAIGDAYPRMRPVADHAAYFPSASAAYGDAAFTCPGNRVAASMADHLPSGRVWSYRYNVRAPELVDEGLGVPHIFELSAIFGVGFAGNSEITSYNGINANAVATVMDYWISFVKALDPNPRRRSQAPRWEAWKPGLGQRLKIQTNTTAMEPIPPQQADRCSLWSALAPEMEI

SEQ ID NO: 101 - protein, 591 aa, Aspergillus niger
  ref <308>: DATABASE ACCESSION NUMBER: UniProt A5ABC3
  ref <309>: DATABASE ENTRY DATE: 2007-06-12
  ref <313>: RELEVANT RESIDUES IN SEQ ID NO: (1)..(591)
MKSTKLAGSIATAALVAGAQAKSLADVCTVSHVQSSLPLDAFTGLEIKTSSVTASPVYNVSVSDQTFYPDGTFDYCNVTFAYSHAGRDDSILLGIWLPAPDAYQNRWLSTGGGGFAINLEGDLMPAGLLYGAAAGITDGGFGAFTTDLDAVFPSANGTINWDAIYNFGYQSHHELSVIGKAFTKNFFNTTASSSKLYSYYMGCSEGGREGWSQVQRFPEEWDGAIIGAPAIRYGQQQVNHLFPNVVEQTLGYYPPPCELEKIMNLTIAACDELDGRKDGVVSRTDLCQLHFNLNSTIGKPYYCAAETTSENLKKRSAHAKRLTVSNITPAQNGTVSAKGAEAAATMLKGLHTLDGKRAYIWFQITSAFSDAETQYNSDTGSYELDIDALSGEWVARFLELVEADNLSSLDNVTYDTLRDWMELGWRRYGDSLQTTYPDLSAFKDAGGKIIHYHGESDPSIPTGSSVHYHESVRKIMYPDLTYNQSTDALASFYRLYLVPGASHCATNAYEPGPWPQDNMAVMIDWVEKGVVPVTLNATYLSGEEKGSNAQICAWPLRPLWKNNGTVMECVYDQASIDTWQYDFNAYSLPLY

SEQ ID NO: 102 - protein, 570 aa, Aspergillus niger
  ref <308>: DATABASE ACCESSION NUMBER: UniProt A2QH22
  ref <309>: DATABASE ENTRY DATE: 2007-03-06
  ref <313>: RELEVANT RESIDUES IN SEQ ID NO: (1)..(570)
MSKFLLWTVSAAALARAATLEDVCTTAHAKAAVPVSGLVQGVVTNPSSITAAPVYNESTAGSDYYPAGTYDYCNITMTYSHAGKDDSVLLQFWMPTPDDFQNRWVSTGGFGFAINVASNVPAGLPYGAVAGRTDGGFGSFDTQFSSVYPLVNGTANYDALYMFGYQAHHEMSSIGKAFTKNFYSMSDKLYAYYQGCSEGGREGWSQVQRFPEEWDGAVIGAPAIRYGQQQVNHLVPQVVEQTLDYYPENCEFSEMVTLIIDACDELDGRKDGVISRTDLCQLNFDLKSTIGKPYACNASTSMGVATPAQNGTITAEGVRVAQTILDGLKDSEGRQAYFWYRIGSEFTDAETSYDSTTGTYGIDISELGGEWVTHGLQLLDLDNLSNLDNVTYDTLRDWMLEGLQRYEDVLQTTWPDLSRFQAAGGKVIHYHGESDNSIPPASSVRYFESVRDTMFPNKTYNASVEALNEFYRLYLVPGASHCNTNSLQPNGPYPQNSLGDLMNWVEKGIEPVTLNGTVLSGDYEGEEQKICSWPLRPLWKNNGTVMDCVYDQKSIDTWLYDLDAYDIPIY

SEQ ID NO: 103 - protein, 184 aa, Trichoderma reesei
  ref <308>: DATABASE ACCESSION NUMBER: UniProt G0RT28
  ref <309>: DATABASE ENTRY DATE: 2011-10-19
  ref <313>: RELEVANT RESIDUES IN SEQ ID NO: (1)..(184)
MKFTALLFALAPAVLALPSSPLANRQGSITAITDQLLFDISLPDFITHRNAKNPSNLDWSSDGCTDSPDNPFGFPFVPACYRHDFGYQNYRIQNRFTESGKLNIDNNFKDDLYYQCQSSSVQSVCDALADVYYAAVRAFGGGDASPGKREESQEDLIKEYEEKVEIYNKLVKEAQDKGLLPILD

SEQ ID NO: 104 - protein, 508 aa, Aspergillus niger
  ref <308>: DATABASE ACCESSION NUMBER: UniProt A2R8R3
  ref <309>: DATABASE ENTRY DATE: 2007-03-06
  ref <313>: RELEVANT RESIDUES IN SEQ ID NO: (1)..(508)
MGLKAFGFIIAAAQISAATAAVSRLTVDTTVGRLYGMVNGSAPDVAQFLGVPFAAPPLNELRFAPPQTKPAEAIIDATKIGPSCPQYPLTTKTDPSVYTFDSPWLQPYGPTSEDCLTLNVWSPLHAVNDTDEPLPVLIWMFGGGFYEGGLLTNGFDPSNWIQRTQSHIVVAINYRVNIFGFPNAAGLAEIQQNLNLGLLDQRFAVEWVRDNIAAFGGDASKITLWGQSSGAASTDYYNYAWPDDPIVSGLIMHSGSVFATGSSADVEHTNFTFVAEHMGCGDLTPRAELACMRNVSADSIIQFYENYTLYSTGPTLKFTTIVDNVTKFEDYTARAYAGNYSKLPAIFGTNANEEASLVAWAGPQGPNMTYVHEETVSTHLCPANYNGHLRYNTSSLSFRYFNTANFSNISPRPWEGAYHSSELPLLFGTYSEYGGPATPFETAVASHWQDLYLAFMRDPVNALPAMGWPAYHPDGYAMMFAANGTVTSLLPMSTLETPCAGIPEPTIG

SEQ ID NO: 105 - protein, 656 aa, Aspergillus niger
  ref <308>: DATABASE ACCESSION NUMBER: UniProt A2Q9L0
  ref <309>: DATABASE ENTRY DATE: 2007-03-06
  ref <313>: RELEVANT RESIDUES IN SEQ ID NO: (1)..(656)
MNGGQAHQRFGMQIPKFQSQSHHPHPAQQAHHHAHHNQASHSINHQHNFSSGALAAATPHFTPGPLQNGAHVNVDEDIDETMNEHWQQQLQLAAESRQASSPHYYARTVAQQTKGIQIAPSQPESQENGSGDRNGLVKSKPAPRQGWHALDFGGQGLRALATSLFHYTFLEKLYLNHNKLKTLPPAIGQLRKLTHLDLSSNDISELPEEIGMLTSLKQLLLFDNNIRTLPFEMGYLYRLEMLGIEGNPLNDVLKSQIIKEGTKALVRYLREEMPVHLPPPDRDWIILDETASSSNSPTEKITVLSHNALCDSSATPSHFGYTPSRVLSWEFRRELILSELRSHDSDIICLQEIDQGSYNGFFREQLAYNDYKGVYWPRGRAMGMQEEEAKSVDGCATFFKGSKFILLDKQMINFGQTAVRRPDAKGQDDIYNRLWQKDHIAVVIFLENRLTGSRFIVVNAHLYWDPAFKDVKLIQTAILMEEITKLSEKYAKFPPCTDKTAFRFSEAEVEYASGDQIPLFMCGDFNSAPGSAAYNLVAHGRLTESHPDLEKRLYGNLSRVGMTHPFKLKSAYNSIGELSFTNYTPDFKDILDYIWYTSNTLHVSALLGEVDKEYLQKVPGFPNFHFPSDHVALFAEFTVKGKKGKVVEADFGPQRN

SEQ ID NO: 106 - protein, 228 aa, Aspergillus niger
  ref <308>: DATABASE ACCESSION NUMBER: UniProt A2R6I6
  ref <309>: DATABASE ENTRY DATE: 2007-03-06
  ref <313>: RELEVANT RESIDUES IN SEQ ID NO: (1)..(228)
MTATAEPQEIIERLKQWGACDVADGLSKLKHPHGGFLEGLTLYSPEYQAGETKIVGQAFTVKFVPKDDEAAPKLSGNYIDMVPPGAVIVISQPLPQVNAVYGGLMTLRAQALGAAGVVIDGRVRDLGEHRALKFALFARSLGTTAGGAVCRPSEVNVPVRLHSEHQEAWINPEDYIVADLNGVVRVPREVVEKVLDVIPEIVEADRKCAEGIRAGRSVEDVFKVFRKR

SEQ ID NO: 107 - protein, 538 aa, Aspergillus niger
  ref <308>: DATABASE ACCESSION NUMBER: UniProt A2R8Z3
  ref <309>: DATABASE ENTRY DATE: 2007-03-06
  ref <313>: RELEVANT RESIDUES IN SEQ ID NO: (1)..(538)
MIFFHLAPFFFLFGLVVSSQNPTVDLGYTRYKGKSLPNGISQWLGIRYAAAPTGSLRFSAPQDPDTVDGVQEAFKHGPRCVPTSQYPTPAGTSEDCLFLDVYAPSSVEATTRLPVFVWIQGGGFNANSSPNYNGTGLIEAANMSMVVVTFNYRVGPYGFLSGSEVLEGGSVNNGLKDQIKVLKWVQEHISKFGGDPSHVVIGGDSAGAASITLHLSAHGGRDDELFHAAAAESQSFAPMLTVNQSQFAYNNLVIRAGCASDSDTLACLRRLNTTELQRININTPLPTAQQAPLYLYGPVVDGSLIPDYTYRLFQQGKFIKVPVIFGDDTNEGTIFVPKTTSTVGEADTFIQDQFPNINFTHLTKLNDWYLKENQTREFPNSSPYWRPASTAYGEIRYICPGIYMSSVFASAGVNSWNYHYAVQDPAAEASGRGVSHTVEENAIWGPQYVSGTPPASYLTENAPIVPVMQGYWTSFIRVFDPNPLRYPGSPEWKTWSDGHGEDYRRIFVRTNETRMETVSEAQRERCEYWSSVGPDLSQ

SEQ ID NO: 108 - protein, 586 aa, Aspergillus niger
  ref <308>: DATABASE ACCESSION NUMBER: UniProt A5ABE8
  ref <309>: DATABASE ENTRY DATE: 2007-06-12
  ref <313>: RELEVANT RESIDUES IN SEQ ID NO: (1)..(586)
MSDQVVVIVPTQTSPSHPQRVIGRKSPISGIEEFRGIPYGTVPARWQHAVLRDRLPQDEFDATRNGPLTPRPEPNNTDEYQSHLEFPADVTESEFDCLNLFITRPSAAALAAAGFDVQEVKLPVYVYIHGGAYSFGAGTDPIWDPARLVKKSVELGTPMIVATINYRLNMFGFAASSEIIQAQPEGQRKGCNFGLSDQRTAIRWVRQNIGAFGGDATQITVGGQSAGGSSSHAHVLEAVLGKGEPLVQRGIIQSGTLGVLGPISMDVSNARWNAFCQHAGAPAGDAISRMAFMVKLPPAEILQAAGKLGSIVCPLVEDGLTISKRPNGRWNVHLDGLQSEPIAETSASGAGVIPVLIGDTDVEGLLHLNVVNGIRNYEHLSEQLSAGVESKEFLEDLYQAYGFEPDTPPAELRKRVLQLLTDIQFGYPVQCARQELRDWEVPRDKLTESPTITRSTAVHSYRMSVGNPFPGPRQGIAQHCVDLIYIYDCFADALRVADEALPAKAPTNAALVDRVQENWIRFITAPSLDSQAGNATVYGSDRTTSTIHMDSDRTWTDRMHRFHILGRHWRSAQQAMQAITGPSHIL

SEQ ID NO: 109 - protein, 400 aa, Aspergillus niger
  ref <308>: DATABASE ACCESSION NUMBER: UniProt A2QE05
  ref <309>: DATABASE ENTRY DATE: 2007-03-06
  ref <313>: RELEVANT RESIDUES IN SEQ ID NO: (1)..(400)
MVKATSAASTSAALYSLAVVLSPASEGPEDVKEKAHHLKNGFQNPWDSWKSPSVGDALHMWGGIITGKIKFPDVTPPTVPVQQPKFLPDRETSSLRATWLGHACYYVEFPNGLRVLFDPVFEDRCSPFSFMGPKRYTEMPCRIEDIPSIDAVVISHNHYDHLSHPTVKEISRLHPNCHFFAPLGNKAWFSSIGIDKMTELDWWEERDIVLSPSHEPVTEAGAAGEGQNSNRSDITTRISCLPSQHTSNRGVFDRSKTLWASWGIEAGGRKLWFAGDTGYRHVPELPAGADDHAPEYTFPSCPAFKQIGRFRGPFDLGLIPIGAYSPRWFMSPMHADPDDAVQIFRDTNCKRAMAIHWGTWVLTDEDVLEPPKKLKEALTKYGFPEVGAFDVCDIGESREF

SEQ ID NO: 110 - protein, 532 aa, Aspergillus niger
  ref <308>: DATABASE ACCESSION NUMBER: UniProt A2R1R5
  ref <309>: DATABASE ENTRY DATE: 2007-03-06
  ref <313>: RELEVANT RESIDUES IN SEQ ID NO: (1)..(532)
MLLILLLLVGAVASSPIHNTFTSPIVHTNYGDILGTTSPYRPNVQVFKGIPYATPPTGELRWKPPVEPQPWTGTYNATAFSAQCPQSLNMGTGLWTTGSTDQSEDCLYMNIWTPTTTPSTPLPVYVWAYGGRFVDGSGDVVTYDGSGLASQDIIIVTFNFRLGPLGFLAHPLLSAESPHNSSGNYGLLDIIAALEWVQANIASFGGDPARVTIGGQSSGSSCSLDMMYSPLAEGLVSGVIAERSLATSYRLKDEAESSGLSVMTSLNASSLSEMRALPVSTLLTTDLLNATIFDNTNYQNVTTFMEPPEWRPVLDGYVLPHTYASTLSNNTHPNIPILTGNNKDESGAATDPGYTLSTFRSNFSTMFAPFPHLAEEFLSLYPANDTQSTTLANNAFWADLGRVSTWAWALDWYAGGATAPVYTYFWDHAPPGQSLGAFHGSEMYYVFGNLPYNYPGMPWTERDFEIERVMVAYWTNFIKYGNPNGEGLVRWEASGKKKETMYLGDGFGRGELTDGEERRELMLQWLRESEVW

SEQ ID NO: 111 - protein, 1045 aa, Aspergillus niger
  ref <308>: DATABASE ACCESSION NUMBER: UniProt A2QRP8
  ref <309>: DATABASE ENTRY DATE: 2007-03-06
  ref <313>: RELEVANT RESIDUES IN SEQ ID NO: (1)..(1045)
MGVPALFRWLSNKYPKIISPVIEEFPQEINGEEVPVDTTRPNPNGDEMDNLYLDMNGIVHPCTHPEGKPPPANEQEMMLEIFKYTDRVVNMVRPRKLLMIAVDGVAPRAKMNQQRARRFRSAQEAREADEKKEEFRKMLEKQNGKKEDEDMQEHVIQKTWDSNVITPGTPFMDILAAALRYWIAYKLNTDPAWEKLKIIISDATVPGEGEHKIMEFVRSQRASPEHDPNTRHVIYGLDADLIMLGLATHEPYFRVLREDVFFQESRARTCRLCGQAGHKAEECKGQAKEKNGQFDEKGKGTSLKPFIWLNVSILREYLAAELYVPQQPFPFDLERALDDWVFMCFFVGNDFLPHLPSLDIRENGIDTLIAIWRDNIPVMGGYLTEDGHVDLKRAQLILQGLAKQEDAIFRRRRQAEERRAANEKRRKQEAQAREEGARKRRKSSPNYEAYDTPEANPTGGRSKGAADAAPPNAVELITPARGELTREARQLTHSMVTNRGAVYKANMANKSAAAILKSKLMKGPEAEEPSDNTGESGSEAPEPSEEKTEEQTSPSVLGKRKADAVAEEAATTPTKKPSAGDSQNDELPPDTVRLWEEGYADRYYEQKFGVDPEDKEFRHKVARAYAEGLAWVLRYYFQGCPSWTWYYPYHYAPFAADFVDIGDMELQFEKGTPFKPFEQLMGVLPASSNHAIPEVFHDLMSDPDSEIIDFYPEDFPVDLNGKKFAWQGVVLLPFIDEKRLLAAMEKKYPLLSDDEKLRNCVGRDVLLISESHPLYHDLVANFYSKKQGAPKYSINQRISEGLAGKVERNDSYIPHSSLVSSLEEYGMPSLDDDRSLTVNYEIPKSKHVHKSMLLRGAKLPPPTLDNADIQAVKNKAHHSGRSHGGAPLRNGHRGGRINYASERPNPFAAHLDPKFMPPGNSGGAPMGMPAGWVPPNAGGGNYNRGPPPPPRGGGGGYHQRSHYGGGGGGDSYNQPTGNYDYYGRSQQGYYQQGSYGGSNHNNAYRGRSNNYGGSDQRGGYSRGGYSGRDHYSSRNSGGGGGYGRY

SEQ ID NO: 112 - protein, 966 aa, Aspergillus niger
  ref <308>: DATABASE ACCESSION NUMBER: UniProt A2QSX2
  ref <309>: DATABASE ENTRY DATE: 2007-03-06
  ref <313>: RELEVANT RESIDUES IN SEQ ID NO: (1)..(966)
MRLAPQTAWLALVAEEAGASLLYDATRPRQLTAASTPRRPSQAALVCFLGRSRKDRALRYLFPDNPSRKVGGFNLRVDHRTWPTERPILFADGDPLRDCQLPDTELLARDEPIPITWSSDPALPLQDVIVARCLLPFAHVTCIFAADLGGLPSVRRLLNRWAVAGRDATRPSLQTRIIVLVDADEVSESDGQALFQQLDGSELYASVHLLPVSRGDVLSDEARYRPVKEEILKALDWATRERVTTQTSFLACHLARFLEGAIRHTAQDHQKPFDLIAAGRPQPRPAEWAACIGDFLERTQAIGSETQDQLLASSLLLDAYPPDTHGFHPRDLFRQRYRQPCLDALRGVACSAAATARADSIESRLVDAHACLLDQDVIPLALHVQHLTEWRAIFERLHSNRTCLGCLLCRPQHPLPCGHALCDRCIERYGRPAPRRESAFVVETCPLCQAPCVTSVVLLPPTAAVRALAVDGGGVRGVIPIRILLGLQLILGPKCSLPGLIDVAFGTSAGGLIILDIFAKHRSVTDCLEAFQRLLFHFFQGPPCSRLFSWPRRMIRSALGRGLYDANELESLLRAHYSDTQRLFSPESRSETKVAVTTTTEDGTALVTNYKAATLRPRNVGYRSVLAKTPEEEPLLWQRLFRPLVLPALGACWDGGLRHNNPVALCRQELQYMWSWQPPLGILISIGTGTRGSRANSPGPERSCAPAPRSHFVWPVLRSFLETMDGKTLWDRFRNQAAAADQDALSRLDICLAGPEPRLDAAHAMDDLIRQTVEQGVGRQGRQCLLRLLAQSLFFELVSVPERETGTPSYWCVGTIRCRVSGEVFLSAIQRVDACQMDYVVGGKPLGISVTDGATCARCGRYCVPVRFRVRRLSDTVSLSLRLDDGRQVPVGGFPNPMDWFLHRQGLSLADGVTEPGAASRDECVACERRLALRRGLRVTRLKARRMVQIAHAIACAAEEAQVTYE

SEQ ID NO: 113 - protein, 561 aa, Aspergillus niger
  ref <308>: DATABASE ACCESSION NUMBER: UniProt A2QE77
  ref <309>: DATABASE ENTRY DATE: 2007-03-06
  ref <313>: RELEVANT RESIDUES IN SEQ ID NO: (1)..(561)
MLKLAVALFSLLAVGNAAPTKVARSTASPTAKVRNGTYVGVTNAHYQQDFFLGMPYAQQPLGDLRFTVPQSLNESWSGERDAKEYSNICVGYGTDSIWYPQSEACLTLNVIRDSSANENSKLPVGVWIHGGGFFEGSSADQRYNMSAIVANSYKIGKPFIAVSLNYRLSAWGFLSSSQVWGTGNTNLGIRDQRLALHWIKENIAAFGGDPDKITIWGESAGAMSVGYHLAAYGGRDDGLFRGGIMESGGTIAASPANYTGYQAHYDELAGQVGCSDVVDSLQCLREVPFEKLNAALNTTSGNSDFNFGPVIDGDIIRDWGSLQLDKHEFVKVPILAGTNTDEGTAFGPTGINTTEEFYAYLTDGESGFQLPPTIAQEILQLYPDDPALGIPEFLGDTRVPSKGYQWRRTCAYAGDYVMHANRRRQCEAWTETSTTAYCYRFNMRAADVPILSGATHFEEVAFVFNNIAGLGYHYGKPFAGMPESYVQLSNLMTSMWASFIHDLDPNSGIKDSAVQWQPYGKDQPVDLVFDANVTSYSYMEPDTWRKEGIDYINSVANAYWR

SEQ ID NO: 114 - protein, 562 aa, Aspergillus niger
  ref <308>: DATABASE ACCESSION NUMBER: UniProt A2QHE2
  ref <309>: DATABASE ENTRY DATE: 2007-03-06
  ref <313>: RELEVANT RESIDUES IN SEQ ID NO: (1)..(562)
MAIMKALLWLSLSLAVWATPVQRDAAPTVTIAHPSATVIGKSGNVESFNNIPFAQAPTGSLRLKPPQPLETALGTVQATGASQSCPQMYFTTDESEFPTSVIGLLADLPLVQSATNALEDCLNIDIRRPAGTTADSKLPVLVWIFGGGFELGSKAMYDGTTMVSSSIDKNMPIVFVAMNYRVGGFGFLPGKEILEDGSANLGLLDQRLALQWVADNIEAFGGDPDKVTIWGESAGAISVFDQMILYDGNITYKDKPLFRGAIMDSGSVVPADPVDGVKGQQVYDAVVESAGCSSSNDTLACLRELDYTDFLNAANSVPGILSYHSVALSYVPRPDGTALSASPDVLGKAGKYARVPFIVGDQEDEGTLFALFQSNITTIDEVVDYLASYFFYDASREQLEELVALYPDTTTYGSPFRTGAANNWYPQFKRLAAILGDLVFTITRRAFLSYAEEISPDLPNWSYLATYDYGTPVLGTFHGSDLLQVFYGIKPNYAASSSHTYYLSFVYTLDPNSNRGEYIEWPQWKESRQLMNFGANDASLLTDDFRNGTYEFILQNTAAFHI

SEQ ID NO: 115 - protein, 626 aa, Aspergillus niger
  ref <308>: DATABASE ACCESSION NUMBER: UniProt A2QPY4
  ref <309>: DATABASE ENTRY DATE: 2007-03-06
  ref <313>: RELEVANT RESIDUES IN SEQ ID NO: (1)..(626)
MGSWTTICGLFVAVLNMILDVAFFWKEVRCPLQPRPVVDESYKLVGAGQVANAAFHLKRLLSWWRSKSPRKRLQHVLRTASTFEDWEEAAFELDELLSMDLWRQNPTSRHYDYRLILGRLEALMSAREDEDILTLANLLRSGLLRNLGNITSPKMFLHAYAGTKLLIDDYITQVALSIQQVTALQTAPIHDSGFSSQAKLELLHDTRQAFGRTTLLLQGGSMFGLCHLGVVKALHLRGLLPRIITGTGMGALIAALVGIHSEDELLTFLDSGAIDLSAFDRRRRMKRPEEESWWLPSNLGDSWLGTLLRRVNRFIQKGYFLDAEVLEECVRANLGDLTFEEAYARSKRILNITVATSNRNATPNLLNYLTAPNVLIWSAAVASNASNNSLYQPVTIFCKDETGSIVPWPHSRDATFYQSWRQGHYKEEESPLARIAELFNVNHFIVSQARPYRIPFLRSDSNLLDRRPTDQWSVTQALMRLFTAELHHRLGQLDYMGLLPATLARLLIEETIPGPHLTLVPDVSLLDLPKLFQNPSKDRLAYWSLKGERGVWPAVSALKVRCVIEIEIDKGYQVVRRRQPSENAPSTPRRMPNEGLPRRRRGYSIDYGRDMLNFSGSLDCQDDSNY

SEQ ID NO: 116 - protein, 339 aa, Aspergillus niger
  ref <308>: DATABASE ACCESSION NUMBER: UniProt A2QUQ1
  ref <309>: DATABASE ENTRY DATE: 2007-03-06
  ref <313>: RELEVANT RESIDUES IN SEQ ID NO: (1)..(339)
MSLYNPQPPYPLHPSVQDKLDPEYVAFYNQYVMNQQQVHLQPVAASRSSGVLIPGGGPVLPVGKTIDLRLPRRVTDGAEVPVRVFVPEGTTPASGWPVMLYFHGGGWVLGNIDTENPVCSNLCVRGRCVVVTVDYRLAPEHPWPAAVHDCWEALLWLTSEGPSQLPIDISKIATGGSSAGGNLACIITQKALTLSPPVHFKAQLLSVPVTDNTASVETNHAYREYEHTPALPAAKMLWYRNHYLPNQADWDNPEASPLFWTGDWSALPRALVMVGELDVLRTEGEQYSEKLKKAGVQVDLQVMKGMPHPFLAMDAVLKEGKRSITLMCDLLTEVFWTKP

SEQ ID NO: 117 - protein, 285 aa, Aspergillus niger
  ref <308>: DATABASE ACCESSION NUMBER: UniProt A2R0H9
  ref <309>: DATABASE ENTRY DATE: 2007-03-06
  ref <313>: RELEVANT RESIDUES IN SEQ ID NO: (1)..(285)
MASTTPSAPPSLTLPPSQFARLQPHAYLLAHLSPPASSNQPSIRANGRAPSQFRVTSANTGSLTHTNGSAVVRVGGTTAVCGDDAEVEDPEDETHIQQLNLLVPNLSLSTGCAPGFVPGAPPSALAQSLSHKILNLLHSTKLEKEIKAFWVLYIDIMIISLAGNPFDAAWASVLAALRDTKLPRAWWDVDNEMVVCSDAVSESQKLSLRGLPRRWILADPDGYEEGLSQERVCIVVDKEQGGKGKTVIQNMEKNGGWAVDGKELKALVDISAQRWEQLKHILEQC

SEQ ID NO: 118 - protein, 294 aa, Aspergillus niger
  ref <308>: DATABASE ACCESSION NUMBER: UniProt A2QS66
  ref <309>: DATABASE ENTRY DATE: 2007-03-06
  ref <313>: RELEVANT RESIDUES IN SEQ ID NO: (1)..(294)
MVRNISILSLDGGGVRGLSSLYILKHIMESIDPENTPKPCEYFDLIGGSGSGGLIAIMLGRLEMDIDQCINAYKRLSNHVFARKRLLPVGGNLRRQSKYDGRRIETAMKAILHELGYEDDILLREPASSCKVYVCVTDDGSKRNLAPLTSYPSKYCSNELYKTAKVWQAGRACFSTEQLFDPVPIGPSGRRFYNSSTDANNRVREVWIEARGIWPSGSLDNQIRCMVSIGTGVPSIKRSGKAMFGLLKTSRTDSIDTEMDMNKFLREHTELDDENRLFRFRCPQWLSGYFTRWD

SEQ ID NO: 119 - protein, 907 aa, Aspergillus niger
  ref <308>: DATABASE ACCESSION NUMBER: UniProt A5ABK1
  ref <309>: DATABASE ENTRY DATE: 2007-06-12
  ref <313>: RELEVANT RESIDUES IN SEQ ID NO: (1)..(907)
MSMEIPAYPHWGISERGAISLKPGCHQVKSMPFPLHNYLFSFSSSTYHTMSDIIQVTTHLGEIRGKTTNGVTQFLGIKYATLKNRLADAELVERRDGGVLDALKDGAIQHTLPKKELTQSDVDCLNLNIAAPAGTPAHSKLPVFVFIHGGGLMIGANSWPQFDYERFVKLSIDNELPIVAVSINYRLGPYGFLTSDELRKAGYKANNGLRDQRVALEWVRRHIVDFGGDSENITVAGMSAGAASVTFHLDSETPLFKRAILMSGSRFFVQALPYDAHEENYRQAISALGLENATSDEKIKALLETPGQDLLAKLPPSVLTAPAVDGDMVPSTVTYAQVADRTSNIPKGKQWCRDLLIGDAQYDSNILAILMPHLKNECAGRLAKAVHSVFPTKQELATRILAGYGLTAETADDEAFPAVLNYLNDIFILAPTLTYTSGWEGHTNVYYFNEENPWEGPWQGKAGHILDVAYLFQNFRDYLTPAQQELAAAFAIDFFKFCHGIKPWPTVVDADIENGFTARVYGPSSEGETVAQVAQAYGGHSRRRSVLFDLSDEASLDELARVATFAKERAGLQLPSSEQKNVILFTQYFFSQRIKSFTFSSLHRPSHSTHPYSHILINPIMQQRRLLLPGEPVPYDPSRPWFPQYGAGNGEGTPYFRGNIIALHSVDYFQAQPTLLICRIVDVHEPFWKVCAVTVQVEGPLGTLGGTLHIRMFDRRFTKGMRLRHGCPNWCYAIESGYRQHGPLPVTPYGQPPEDPNVRSLNQREDDTQKAMTHSYRTELQAYDTLSDLQAGHIPKLLGTATMAWQVMNEMGRTIIGSCPGLILVPLDGMPLLKMNYILKRTWQFIFWDLVNIRQILQSRGLYTIDTTPRNIIIVPCHPWGLFKVVLHSLQLNDGPGETGASTTNTG

SEQ ID NO: 120 - protein, 321 aa, Aspergillus niger
  ref <308>: DATABASE ACCESSION NUMBER: UniProt A2QK90
  ref <309>: DATABASE ENTRY DATE: 2007-03-06
  ref <313>: RELEVANT RESIDUES IN SEQ ID NO: (1)..(321)
MPFWHRVDCFIRLWLLKSLAAIYFYYRRLVRQPPRRYQPTFVRRYPSRPMLNTHIFFPPNYRTGELLPLYLNIHGGGFAVGDAQVDDRFCVAWAERTGMLVVSLDYRRVPRHPFPTATYDLVAQIQDVLADESLPIDPDRITIGGFSAGGNLALSVSQLPPLHGRVKAAVVYYPIVDFGHPPPVKLASRPYTDGPLDKIGMMAWALDWGYVCVGQNRRDPLLSPWYAKPEDLPPRIYMIAAQWDMLRLEAQQMIHRLAGLHDKEDQEAPFETAAYKWTLARGCTHGFTHGQEGTAAERAYRKKVCEEIYGQAHEWLQSSLS

SEQ ID NO: 121 - protein, 584 aa, Aspergillus niger
  ref <308>: DATABASE ACCESSION NUMBER: UniProt A2R8R4
  ref <309>: DATABASE ENTRY DATE: 2007-03-06
  ref <313>: RELEVANT RESIDUES IN SEQ ID NO: (1)..(584)
MASTSAKESSGVVQQPIELSTSGTMNENYGPNQCGSENIVSNTQDLERVPPQGLQSESGTPEPRSNWKVFATMLALSLALFISALDQTIVATATPTISADLHSASGYVWIGGAYLLANAASSNIWANLSDIWGRKPILLSAVALFFVASIICAKANGMPMLITGRGIQGIAGGGLIQLITITISDLFSVRLRSLFLGLIEFIWAIAGALGPIVGGAFTQSVSWRWIFWINLPVCGTAFVLLYVFLDIHNPRTPVLAGIRAVDWWGSFSMLALIILLLLGLDFGGATFPWGSPKVICLIVFGCLMSFAFIYSEKKLARYPLMPLGVFRNRSNVACFLVDFTHGFAYLGAEYYLPLYFQSAKESTPFRSGVLILPFVLTEAAFSLFSGLLIHRTGRYLEIIWAGTALVVLGTGLFTNYSATSSLGKIVGYQITAGMGCGMLFFPPLLALQSNISQANTASATATFGFIRNVAMAMSVVLGGVVFQNSMDMRQDGLKAAGLSSSLLAEFSGTEAAANVNAVRAVQDPTQRHAVADAYAWSLRNMWIMYACLAACGFVASVFITRQHLSEEHVETKTGLKEKQPVSEQ

SEQ ID NO: 122 - protein, 534 aa, Aspergillus niger
  ref <308>: DATABASE ACCESSION NUMBER: UniProt A2QVF5
  ref <309>: DATABASE ENTRY DATE: 2007-03-06
  ref <313>: RELEVANT RESIDUES IN SEQ ID NO: (1)..(534)
MALRSMPWASMSILSLFGVGAASSPCTEGTFSSLNLSNIDILSLNVTAARNYATGASLSSGTTSAPVGQMPSTVDICIVSLQYTHPGQNDIVNTYIGLPLNDSNWNSRFLMDGGGGWVAGGLDEIIAPVASGYSSSSTDGGHNSTASTADWGFVSEGNTNWPALWDFSSVALGEAAVLGKLATEIYFGSPPKYSYWNGCSTGGRQGHMMAQRFPTYFDGIVGGSPAINWDKFQLAEFWPAFLAQLLDTQPPACLLDAFTDAAIDACDLLDGVKDDIISLPGQCHFGASSIVGQTVNCSDPDGQIAITDKMAELVQGMWDGPRSLEDQFEWYGLGYDADLTALLTTTCTSVDNCTVTPFSISADWARIFLARNSSFSIQGLTRQDFDDLYRESVDQYASVIGTRNLDLTEYKLAGGKMISWHGMQDELIPTNGTVDYYSRVMELDPSVADYYRFFLAPGVEHCEGGNGFDPNDYVFETLRAWVENSTVPDTLEATAVAVAGSNSSSTRTAYLCPYPKIFTYVGGDPNDAASFSCA

SEQ ID NO: 123 - protein, 782 aa, Aspergillus niger
  ref <308>: DATABASE ACCESSION NUMBER: UniProt A2R7H4
  ref <309>: DATABASE ENTRY DATE: 2007-03-06
  ref <313>: RELEVANT RESIDUES IN SEQ ID NO: (1)..(782)
MDSTADFGSLQQRVQSSLMQVTRTAGQLSAEDLDFHRTSNAEVSDSLDEQSNRLLSLTSSILKAATAGTDVSAPTLDDEDSLEDNWRGVVDVIDALLEKADACLDEFTGVIKKLSPSQQDQAAAAAAKASKKQPAKFPTIYDYGPSKIPKPQLLFERKADNTDTAPFKPLLKTKPHAVVPLKDSLKLSDSAVGYVNPYEKEIRAAKFPTSSYSVSPPVDYQPWESTKATFVDTLEGVKEMLEELKAAKEIAIDLEHHDVHSYQGLVSLMQISTRDKDWVVDTLKPWREELQVLNEVFTDPNILKVLHGSSMDIIWLQRDLGLYVVGMFDTYHAACALNYPKRSLKFLLQKFVNFEADKRYQMADWRIRPIPEGMFDYARSDTHYLLHIYDHIRNELVENSLPDNNLIDYVLEQSKKEALQVYERPVYDAATGQGPGGWYDLLSRNSVVVNREQFAVFKAVHQWRDEVAREEDEGVQCVFPKHVLFRVAHTMPLDLGTLFRTLSPVTPIVQNRAVDLLEVIKKAKDEGADGPEWRDVYVKPTRGTPAAPATQPVDVPSPTPADEANLPTVSRYEVSQFWGSVLESQEPPTVPAYSAVASAEALRLSLPLPPMPKTVSEAREKLAPAQPQTPKPATSAPAVKEEKKEDENKYFTVKEMGGPRKRKAAPAETAEQLQSASSDFDTTDASSSLDTEDKPSKKQRRKEKKNKPAAQPETAAEEDGEEEEEEAPFNYESAASVFNANPKATSGLPSRRRYNPYAKVLDAPSGVRKQKRETAGKAFTFR

SEQ ID NO: 124 - protein, 951 aa, Aspergillus niger
  ref <308>: DATABASE ACCESSION NUMBER: UniProt A2QZY6
  ref <309>: DATABASE ENTRY DATE: 2007-03-06
  ref <313>: RELEVANT RESIDUES IN SEQ ID NO: (1)..(951)
MSDRLSHRWLQPAERHGGAYVHHSRRLVQIRDQLASPQTQCPSLIVFLGNRKKDVALRALFPDNTLSQRQPYIQLDVDSRTTFADHPLLFSHCDAKLEFHKTDRIPREYEEIPLRWPLIDLHHASDIILCRAMFMFTDVICIFADDLGGLDAVRDLLIRWAMVGHNASSLEYRPRVLVVMETDHNSPTYETLDEMDFDFVLGQNLNVTEVFVTPTLHRLPGQALSDIAQHCSLKNDLLKLADISRRDRKEQGYLFSVMHMAFFFQTALNHVCRAPQAPFDFVRGARAGIEVGQSHRFHLRDFLIVTRDRGWNLEDQASHIASTLLVDAYPPGSHFFSPAAVFDTLYRHHCQEALRSAELSSCCQPIEYHFASLRARLLLGKGPPRRIHEEGLARRRGLFRMIASSHTCLLCLSKPPQHPLLCGHAYCDVCAAWYGSPVEGAEYEYSVRHCALCHKATDILIRVLPPTASVRAITIDGGGVRAIMPLRFLGYMQKILGPGCLVQDMVDVAFGTSGGGIAVLKAFRQRRPISECQQTLADLIVRFFQGHPPLRTTWNKLIRTILCWWKDGWYDAGLWDGLLQKEFGVDQGMFDVQPVSGTKVAVTAVADQPVLLINYRRVVDPPGQRCVDHEMQTTGVASLAHSGGYYRVYTAPDPEHEPQLWKCCADGGLKHNNPALICRAETPFMWESNPVPGTLISLGTGKAGRPRRQRWRRGFAFRLYDSFLASMDAEQAWEDLLGQVDPANRRNYHRLNVTFPDQEPLLNAAAQVEWMTELADKTAERQVPGALTSLLLASFFFELSSPPCYNDGIYQCCGAIRGRLRGKYLVQALRRLHPQASTFVLGTSRLGVSPFEDAVCCDCARYCVPVKFEVDGLDSNIMLALELHPHQLQPLGGFPLSLRHLVDRLRINMIGCPGLPKLPARTECKSCELRIRRKARPDFENSSYRKRVRFI

SEQ ID NO: 125 - protein, 874 aa, Aspergillus niger
  ref <308>: DATABASE ACCESSION NUMBER: UniProt A2QX56
  ref <309>: DATABASE ENTRY DATE: 2007-03-06
  ref <313>: RELEVANT RESIDUES IN SEQ ID NO: (1)..(874)
MPLNTFALSVALTPAVLQTLISHYVHRKSLREKPNVHITYDEAIRILREFLVYASKHPVEDLQAFTCQRVPAPHWVKLQTVTVSEAYLSSAAKAINQQLGPKGIARVGGSEWWQWRGPAEDLKGEWIEMKDDYNERKQTSRDHPSQKRIMLYIHGGAYFFASLDTHRYQMQRHARKLKAKYRLAPQFPFPCSLQDSLAAYLYLLEDHDPKEIIFAGDSAGGGMVLSMLVICRDQGLPLPAGAILISPWVDLTHSFPSIVADNPGDYIPPYGFRHKPSAAWPPPNADELRELKKGLKKHPASQSEALKAIPNDSEAEDTAAKGYSSRRNSAADAKRACDIEHETVKVVLDGETVEVKDQIHMYTTNELLSHPLVSPVFQPSLGGLPPLLIQSGGGEMLRDEQFYIAHKAANPTAYPPSDKFLDEHDPSREILRKYPGTHVQLQVWDDLCHVAPTLSFTRPAKYMYRAIAQFGAWALASNGTAVASVGKAGDPLPAFKDRMIRQRVDKRGNIYPLDPPSACPVLQIPSSEVGTFNPKLVRGWLAAKEEWDEKFAKEKLRVQRQRIKELAYGLQAFKDELPPPSSLAARRHAPGVLPSKTGRKSYPMTMWSRLASKQDERSIAKEQLKGGEVKRKSVDAGRAGASMDEANRSKAESLRPSSQPATLASHPTNIVIVPTRSEKGSVASHKTSTDAVDQLGTSPPQGTALSKSSSRLMLLPEYEGKTLLDENASTRTLFREAGAIPTSDGAWSRLRQRPLSHAGSGTIRSEFTSELPEDSSTIGDEKSLAVTNTGVDEASTRAVLRAGGVVGLMSDDGDSAYRSFDAQSTTDAGDAESAPGGVHGDSGGVNGSAEVDKHARPTMPDREFFKTAEEYVPY

SEQ ID NO: 126 - protein, 673 aa, Aspergillus niger
  ref <308>: DATABASE ACCESSION NUMBER: UniProt A2QMK5
  ref <309>: DATABASE ENTRY DATE: 2007-03-06
  ref <313>: RELEVANT RESIDUES IN SEQ ID NO: (1)..(673)
MRSRTFITTLGLLYSCVPAEASLTILFQNDGNWTTHAEKPSALFVNNALAYQDAQATCAQYNESLLSCEEYPDFHYSFTYQQYLKNIGSDQLFWSSCSSDRPTSWNGELVNTSSTAGLPFLCSNSAGFVNQVDTDYSHFPRVNASANGVTFEGLRDHMAFRFMGIPFAQPPVGELRFKYAHEWAQSSYVNATRYGPACIQSGWYDGNSYGLNPWGNSEDCLHLNVYTPSLPSSKDKTNSSRPVMLWIHGGGETSGTGADSTFDGDSFVSRNDVVLVTINYRLNIFGYLSLDDSTIPGNYQLTDKIEALKWVQKYIRAFGGDPNNVTIFGQSAGASSVIDLLTTPKANGLFQNAIGQSIAGHVETSNASAAAILPYIQPLCGSTTGTQRLNCLQSLPAEILLNISSSVTWDTVIDNRYIFDYPLTQIAKGVINKVNFITGFMPEEAQSILQTTISPNATNFTTTLQTLVSSGSITKSEEDAVLSSGLWRNYSTPYNASIHVDSPAGMTCYSKEFASVGAASHAYNSLYVYLHQRAYGLNYYDWYDLCTYPVGKPDTPYYKCHSGDLYEVFGTYYLFDLPIRAPEDIYYTNMVQDMWAAFARRGDPNVDEGYLRARGYFSSLKLMERWQWDEFTKGSGSKNVANLQYPVPFYSELPYMEEYSLYLGIVTSYTGDD

SEQ ID NO: 127 - protein, 440 aa, Aspergillus niger
  ref <308>: DATABASE ACCESSION NUMBER: UniProt A2R234
  ref <309>: DATABASE ENTRY DATE: 2007-03-06
  ref <313>: RELEVANT RESIDUES IN SEQ ID NO: (1)..(440)
MRSVQCFSKTSRIITKTMTSKTKYTWTFSAPSASKAAPESASKKDHWVRGEGHPEEVKGFRNPWESSRDFTFPELFKSMMRHKFLSGNSQKPDTTLSTVPVRTSTFLPAATCPNLLRATWLGHACYFVEFPTGLRVLFDPVLEDRCSPFSWIGHKRFTPPPCDISDLPIIDCVVISHSHYDHLSYPTVLEIQKHHPSVKFCVPKGLKKWFVDCGIENAIELDWWEDVSLKLAYTTEDNAPSVSSQDDFIASATISCLPCQHTSARTPFDKATTLWASWSVSSGGKSVYFAGDTGYRSVPYVPKEVDDWGADYADLPVCAAFKEIGEFRGPFDLGLIPIGAYRPRHVLSTVHSNPYDAVEIFKDTRCKKAIGIHWGTWAVAEEDVMEPPSLLKDALVKSGLPESDVFDVCGIVIFLSLHRLLVPPDKDLSNELIVQLTVGV

SEQ ID NO: 128 - protein, 551 aa, Aspergillus niger
  ref <308>: DATABASE ACCESSION NUMBER: UniProt A2R4Z2
  ref <309>: DATABASE ENTRY DATE: 2007-03-06
  ref <313>: RELEVANT RESIDUES IN SEQ ID NO: (1)..(551)
MGPSLGLAAWASLLTVVSAQFKCSLPAGDICAYENATTYAAVNAPNCTTSGLQAFLNKLPGLEGTTLSVPYAFYIDSNATLDEFTDYVGASTFTTDIPSGATWGLGALLPTHFNGSIMMAAPDSGLSWGVASAGLRYAFATFASNSGHDEPDHTPGWETPNGLLDWSHRALHLSTVTAKAIVKAWYDVEPKYSYITGCSDGGRQVMKSIQTYPEDYDGAMAGAPTWWMTHQAFYDYKQTTIGGSARSNSSIPPSLYPVITDEVLRQCDPQDNLTDSIISNPRGCFFNPEALACSSNKTSNCLTAPQLDTLHKIYNDWTTFDQDLIYPGAWFGSEPTWNTTFGSPPSKSWYIENVLGFKNFTAQDLTYEIIAEADARDPAHANADDFDLSPFFNRGGKFFHWHGMSDSVVSPGSSVYYHHKATYAALEKVIDIDQHYQLYLIPGLEHCTGTPSCMAALWYLAGPYQAGNFFNSTPANVVDNYVHDSFLTLISWVEGGHAPSYMVTTNFEDNADPTTLLHNRKICPYPKQANWTQTDAEAEQILSDSLKLYYM

SEQ ID NO: 129 - protein, 1406 aa, Aspergillus niger
  ref <308>: DATABASE ACCESSION NUMBER: UniProt A2QUD7
  ref <309>: DATABASE ENTRY DATE: 2007-03-06
  ref <313>: RELEVANT RESIDUES IN SEQ ID NO: (1)..(1406)
MGVPKFFRWLSERYPAISMLIAENRIPEFDNLYLDMNGIIHNCTHKDSDSPTFRMTEDKMFIAIFNYIEHLYGKIKPKKLFFMAVDGVAPRAKMNQQRARRFRTALDAETAKEKAIAQGIEMPKEEAFDSNCITPGTEFMAKLTEQLKYFINKKISEDKDWQGVEIVLSGHEVPGEGEHKIMEYIRHAKAQPLYDPNVRHCLYGLDADLIMLGLLSHDPHFSLLREEVTFGRQVQKKSKELEHQNFYLLHLCMVREYLELEFQELEQEGVLSFPFDMEKVIDDFILMAFFVGNDFLPNLPNLHINEGALAFMFKIYKESLPKMGGYINEQGVIKMDRLGILLDALSDVEFRFFEHEYSDAQWIRAKKGEVTEPQSKPKGLTITPAQKELFKQVKKYVLNRPEKAAETKPLDFASSLPARDRKFVEQLADDLRLPWTTVADEHGDRFIRVQLPGNDNEDSDDEDEEASVAVQRIIRRYDNAKVQELSAEEAQQAAEKKYEEKFQEWKNNYYVGKFGWGLDSHEEMKELTENYVQGLQWVLYYYYRGIASWPWFFKYHYAPMISDVKKGLNADTNFRLGKPFRPYEQLMGVLPDRSKKTVPAAYRDLMTSPDSPIIDFYPRDFELDMNGKKMEWEAVVKIPFIEERRLLDALATREHLLTPEEKARNGFGASLKFTYSPEVQFIYPSSLPGVFPDIPNCHCIENIFDLPTMDGLEPYIGLMDGVQMGAAALAGFPSLQTLPHVGQLGHHGVTVFQQESRNESMVITLLDPGSRSSVELAKQKLGQRVHVGYPFLQEALVIRVSDELFDYILPEPTGHVVSIPHTPAQIDQWKRKAERIESSYSKRLGTIIGPVESMVHVQLLKGLIKTDEGATVKEFADIPGQETDYALQLVVDDVINPDQRFIEREALPIEEEFPENSRAFMLGEYNYGRPVQITGHDHGKVNGMIAAVKGREPEFGRDRARDAERLCPYMPSYAIARSLRLNPLVLAKITSSFSVDVEGQRVNLGLNLKFEARKQKVLGYSRRGDSGWEFSPKAVELLQQYMIKFPEFIAGIQRNPQNDRYTPTDFYPEETALLKMKEIRDWLKSIEAKNFERVPLDAEQLDSDLVKLIEQDADQLLQSMPPMEVKAVRGLPRSALLRPSDVEQRLGNQTFKLGDRVVYAQDSGKVPIATRGTVVGLTRTPRALLLDVVFDVSFMSGTTLGDRCSPFRGQTVLASSVLNVSYRQLTVNTRASSSAQKQSQQTPLTVAGYGAPLGPGGQGQLREAPAPPPLGNSYRGAVSGMGNGRGRGGRGASNGVGAQTTLPFRPQPNGASPAGGRGRGGMNGGGRGGRGGPARTRGGYVAVDNNPEAGVLNHNPNFRPKNYSQVPPPQSISGRGRGRGNNMRGDRGTGFRGRGRGRGAAVAGEN

SEQ ID NO: 130 - protein, 984 aa, Aspergillus niger
  ref <308>: DATABASE ACCESSION NUMBER: UniProt A2R5V7
  ref <309>: DATABASE ENTRY DATE: 2007-03-06
  ref <313>: RELEVANT RESIDUES IN SEQ ID NO: (1)..(984)
MTTGPIHTYGPSCLLAEDDPDLSAWLSSDKPPSVRPQFFYTSTLAIDDPLAALPPPTGGQGSGNEWAPLQPFSVRDNAALEDSWRQLQQTIRQELDGKYKSHSATSSTRNLGIDVPGRGYAGDTGKLKQKGLHDRNLASGQKSAADAPSRSLDDRLPPSSQIRSRIEAGKAGANNKGSRERSRTLGSSLDGGPAAGAVLRRRLEPPFNDKFGSVETKANEVLTSDDTGPDGAESTSPRSYPSRDVSISGSPFARAPVSPRHSPLGRSVESISSKDENQDSLIDPPTQSAPKPSGLRTTIRQSSADEFHDETGEANPAEEPRHKVPVGASRLHLVELPSLKMKPIYWSPLHDISSVFRATWFYKNTMLPVETELANRLEDGYNYLKPWTETWQDELNSCVENGADAELKIVHKLWPKENTTRPPTAVAAPGSEIRSSTARLSNEDKRKIPEIMPLDLNRAAGSTSAQSDTVKPFLNSSVIYADARNAQILRPSLLPSVSRGRKPLSAIRKGRQIGIPVIRGFSRRLWDRLHPSKPSPVDVRNYLRSTQSRAMSTTSLEPICYACAIEGLRPAPTDLVLVIHGIGQKLSERMESFHFTHAINAFRRQINVELNSEPVWPHVRPGHGGIMALPVNWRSTLSLDEANLESPAGEDPAANHYSLDDITPQTIPAVRSLISDVMLDIPYYLSHHKPKMIRAVVKEANRIFRLWCENNPGFQQNGRVHLLAHSLGSAMALDILTHQPTKIPSFNFSKTEVHGDIFEFDTKNLFICGSPAGFFLLLNKANLLPRRGRDKPGCEGDDRLRGVAGEADTYGCLAVDNLYNIMHTTDPIAYHVNAAVDSGLARSLRPASIPTSAASFWQSVGSVFRWSNPPALLPSNTTVPTRPATLNKLPTNVELETHDFTHEEIAEKRMFLLNDNGQIDYFLSGGGGPLNIQYLNMLSAHSSYWTLTDFVRFVVIEVARKQGREYTLPVLRAAKKKGWKIHKG

SEQ ID NO: 131 - protein, 528 aa, Aspergillus niger
  ref <308>: DATABASE ACCESSION NUMBER: UniProt A2QYS7
  ref <309>: DATABASE ENTRY DATE: 2007-03-06
  ref <313>: RELEVANT RESIDUES IN SEQ ID NO: (1)..(528)
MLPKLATLVLAPALANGVAAAAEPLYKKPVNIPGYGYVQGKAAVNSSVSEYISNWENISFFGGIPFGADTSGANRWRDPQPVEPWNGTLNATEFGAICPITLSVLADYAQSEDCLNLNIWTPATSADEKLPVAIWSYGAGTAPPQTTYNGAGVADKGIIFVSYNYRNGVFGFMAHPELTETNGRNASGNWGVLDQYAAVKWVHENIAAFGGDPDHISVIGQSFGAAATYHIVNSELTADLGIVNAISESGVRSPNDPNTGVFECAYTTLDDAETMGEEIVNSLNVSSIAGARAIDTTTLLDSTSTYSLEVKPVLDYYAIPSKYINTLEKGAGNKVPYITGNNANEDGASATVSTTVAAYKSSLNSSYGDFAPRFWALYPADNDTQAGEQEDQIVRDMFRVSSWQYMNGFSNSADQVDTYTYYWNYGSAAHASEIVYVLNNLWAQGEDYSEEDYYVANVMSSYWANFMKTGNPNTGGSYDNGTLPAKWNANSPSKNETFLAGAVYETMDTAATERVQLILDYFAAQTPY

SEQ ID NO: 132 - protein, 310 aa, Aspergillus niger
  ref <308>: DATABASE ACCESSION NUMBER: UniProt A2QZ17
  ref <309>: DATABASE ENTRY DATE: 2007-03-06
  ref <313>: RELEVANT RESIDUES IN SEQ ID NO: (1)..(310)
MSSVTRPPLHPTLSAVHQTIPTMDISTPEKRRVYRDYLTTNFTLENTLKGHESTIAYQEVDIPGPAGPLRATIFRPKHTILDVSSTPGILHLHGGGHSTGNRFMGFTVLDWVEALGAVIMTAEYRLAPEHPQPAQLEDSYAALKWMSEHADGLGFNASKLVVCGGSAGGNLAAGLSLLARDRAGPAIKGQVLMYPWVDDSVEWNSMEQFGDIAPLTKADAAQASDFAFGVKREFADMYTVPLRAESFVGLPETFIDVGEADVFRDQDLAYATRLWRDGVATELHVWPGCWHGFDAFVPEAEIWCICFLFL

SEQ ID NO: 133 - protein, 288 aa, Trichoderma citrinoviride
  ref <308>: DATABASE ACCESSION NUMBER: UniProt 0A2T4BJD9
  ref <309>: DATABASE ENTRY DATE: 2018-07-18
  ref <313>: RELEVANT RESIDUES IN SEQ ID NO: (1)..(288)
MRSIPVISSFVTVLNAFSIHRKPHADFKYLVTFGDSYTDNGRLGYYSSHDAHGPPPGVMPPEANVTASGGLQWPQYVEASTGATLYDYAIAGATCDNNNVERWAAFMNAYYPSIITDELPSFKADRKTKLYRGVTSENTVYALWIGTNDLSYTGILSDSQVAGTNITTYIDCLWNVFDAIHAAGGRRFVILNNNALQLTALYRPLSDGGAGDNQFWANKTLYNQTEYAQKMLEYTVSANTMIDYGVPFHLLVKNRWPGSKIAVYDIHSLIMDIYNDPSRYLEPPHNIV

SEQ ID NO: 134 - protein, 612 aa, Aspergillus niger
  ref <308>: DATABASE ACCESSION NUMBER: UniProt A2QNW9
  ref <309>: DATABASE ENTRY DATE: 2007-03-06
  ref <313>: RELEVANT RESIDUES IN SEQ ID NO: (1)..(612)
MPSPSKRIILEKSRTVRRRYQRSNKRFQFTASQIARIEREQEREKRAQQLRDKEKKRVANKKKKAEKEARDREERRRLGRMGLPDPNAPAPPSSQPLLFKFIKKRDGEEGESNSGGGDTEVDEGGDTEVDEDLLEDLEAVVDAAEADLDLDLDTEDEGEEGEGEDHRDEATSCDLGESEDEQQVQAKEEDEFSDCCSIFYDEDIIKETGNTTAPDQGAPQDKPQPENHAQPENHSAADSFQDDTALLLEEFGYEFDIDEEFEQALVALDAINKALPTRRRSACRIAAPLVGSGGDKLAARLPATKPSIRRIQHELDAYPIDHLRQASPLSTFPPFTFHYPLETHSRRDTMPTVTVNNHQVYYADTHPDGAPANGQTIIFIHGLGSSQNYYFPILPYLSNHRCITLDTYGSARSTYTGDAISIASIASDVVGVLDALQVPKAVAVGHSMGGLVVTLLGAQYGDRISGVVAIGPTHPSEKLTEVMTQRSETVSKAGMEPMANTIPNGATGSRSSALVKSFIRELIIGQNPKGYAALCLAIANAPVIDYSKVTAPYLLIAGEEDKSASMEGCEHIQASVSSAQKKLEVLRGVGHWHCVEAPEEVGGLIGGFVQTL

SEQ ID NO: 135 - protein, 758 aa, Aspergillus niger
  ref <308>: DATABASE ACCESSION NUMBER: UniProt A2R780
  ref <309>: DATABASE ENTRY DATE: 2007-03-06
  ref <313>: RELEVANT RESIDUES IN SEQ ID NO: (1)..(758)
MGIKGLHGLLKSIQKPCHLKKFSGQTLGIDAYGWLHRGTVACAVDLVLERPTRKHIDFVLNRVRMLLYFGVTPYLVFDGDELPSKAGTEVERQKRRQDSKALGLELQRKGRIAEAYQELQKAVDVTPLMARELIEELKKINVQYVVAPYEADAQLAYLERQGVISGIISEDSDLLVFGAKRLLSKLDQHGDCIEINRADFSACREVSLIGWTDDDFRRMCILSGCDYLPNIARLGLKTAYRSIRKYKNVERALRMLQFDGQYHVPSDYLDNFRQAELTFLYQRVFCPKAGKLVTLTPPEAEIILEDLTFIGGDVEPDIAVGVARGDLDPTTKEPLVLKPSLAAKPADKRLTNTISRRQTLGSSAELKPNKPINSFFTPKRVPLAELDPNSLSPSPSQQRLLQRHANSSWDSVPAPSRPALIRSASSVGSSNRASSPLIRSVERNAFLAHASRTSNLQPAKRQRLCSDAEEANLPNPPDCRSRFFSGSVDDSSPSAQKATRTKKARKSTLDVFSDDSAEDLMTQLPDPSHATETPRVEIQIIGDNNSSISGRSIQTPAAATSGSGASESPAANCKDPTEKQSFSTAEQASEKRSNAVDDSPTPDLVPNANSATLSKYVFQAGNVSVSPRNDKHGGKGHQSGSLDEHMVPTGVRHGLLGHSPRRQRTTPLQRLGQSALARSRSLNCVSPSLAAFRASETPTKSPAVAKLDSNPVRSLATPSQGSEDMIIPDSEDEESEGETQAPVGLASFDVRRFSFMGK

SEQ ID NO: 136 - protein, 293 aa, Aspergillus niger
  ref <308>: DATABASE ACCESSION NUMBER: UniProt A2QF64
  ref <309>: DATABASE ENTRY DATE: 2007-03-06
  ref <313>: RELEVANT RESIDUES IN SEQ ID NO: (1)..(293)
MFSIVYLYYKVLAFLIRRFIAPKKNTQATPDDVYQIPSRDSGRTIKAHVYRNATASTGPTPVLINFHGSGFMLPRHGADDAYCRQMSRETDRTVLDVQYRLAPEDPFPAALNDAEDVAKWVLGQPEKFDLGRVSLSGFSAGGNLSLAAAANLFPPETFHSVLAVYPVVDLHTDPALKTAPDTSGRAIPAVISKIFDRCYTHAAYDTRDPRISPLYASADRFPARVMIVTAACDNLAPEAEALAEKIAKEPGKEVVRQRMQGCNHGWDKSARPGTVQGDAREKTYAMAAAMLSR

SEQ ID NO: 137 - protein, 286 aa, Aspergillus niger
  ref <308>: DATABASE ACCESSION NUMBER: UniProt A2R835
  ref <309>: DATABASE ENTRY DATE: 2007-03-06
  ref <313>: RELEVANT RESIDUES IN SEQ ID NO: (1)..(286)
MRVGKSTLFGGLALTPLTLAVPMLQSRATSDPAEWTELHRAAQLSSAAYTGCTGSAFDVTITKQINELVTDTQGFIGYSTEKKRITVAMRGSTSATDIANDVDTTLVEPTLSGVNFPSGAKMMHGIYSPWSSVHDDVISEVKSLVEQYPDYTIESTGHSLGGSLTYISYIALAQNFPGKTIISNALAAYPIGNEAFANFGASQNGTLNRGNNADDGVPRCFRTCTSCGPGTLFTMAPSGTQASTVKCSGERDTSCSAGNGQVGVTAGHFSNFGIAMGMAGCSSSLL

SEQ ID NO: 138 - protein, 410 aa, Aspergillus niger
  ref <308>: DATABASE ACCESSION NUMBER: UniProt A2Q8R7
  ref <309>: DATABASE ENTRY DATE: 2007-03-06
  ref <313>: RELEVANT RESIDUES IN SEQ ID NO: (1)..(410)
MSELQKSFAKSRLAKLPLQPPTGPSMQSLDEEVSHDDDSSSTSSTGTVVPSPSRQLFARPGRGSVQQTTLPWTDYFTQELYLTQIDTSNNTKITHHVYLTPPADSSSPLFVMHHGAGSSGLSFAACAGEIRKIIPKAGILSIDARDHGSTEDGDGSIELDLSLETLNRDLVFVVRETQTRMGWENLPDLILVGHSLGGAVITDVARQGELGSKVLAYAVLDVVEGSAMDALQSMETYLMTRPSRFPSITSGIEWHTRSRTIRNKTSARVSVPSLLYEDPNSPDPTKPWIWRTNLSATKPFWENWFVGLNRKFLDARGGKLLLLAGTDRLDKELMIGQMQGKYQLQVLPEAGHFIQEDQPAKTAQILVDFYKRNDRSALVLPPKVADLQASAAMKKGAGSGAGAGGLFKKI

SEQ ID NO: 139 - protein, 613 aa, Trichoderma citrinoviride
  ref <308>: DATABASE ACCESSION NUMBER: UniProt A0A2T4BFY3
  ref <309>: DATABASE ENTRY DATE: 2018-07-18
  ref <313>: RELEVANT RESIDUES IN SEQ ID NO: (1)..(613)
MAVIGLAHAGSLKDIDHVVLFMQENRAFDHYFGTMAGVRGFADANLQMNNGVPVWKQVTDSQLTNDTDYVTPFYINYLGGNWTNATQCMLTGTNSWQENHAAWNNGSNDRWAVDNSPYSIGFYKRQDIPIQFALADNFVVVDMYQEAIVAATNPNRVTWLSGSVNAPGGPQTPDEGGNPYIDNNITPGCEAGGFNCYPLKWKTVGEHYEDAGVTWQVFQDADNFDDNSYARFQQFQEAEPGSSLYERGMKGLTLDTFYAMAANGTLPEVSYIVGPMELSEHPPYSPHDGAWLQHQVAQAVLTSPKYNKTVLMISYDETGGWFDHVDPYRSPKDTAGEWIQDPYGQVGYTFVGPGFRLPFYIISPWTRNGGVYAAHSDHNSQIMFVEKWQAAKGRKVTTEEMVHWRRSHMSDLTDAFDFDHPDYSIPELPEPQTPHTDSSGVYDGSSYCQSLYSEVQPPVPYTGTGVIPDLTTQVEKGFKPLRGMLTEGRHLVLEANGFALAQKTTFSSALALGRATEEHDAVAQRWIAHAVTIGGDEFTLSDDSGRNYICENGVLCGDAGKAVVFTVGYKAGKGYSFQVKGTERYLSVGGGGTSSYASLDGGLGYWKVYSVSY

SEQ ID NO: 140 - protein, 546 aa, Aspergillus niger
  ref <308>: DATABASE ACCESSION NUMBER: UniProt A2R1P3
  ref <309>: DATABASE ENTRY DATE: 2007-03-06
  ref <313>: RELEVANT RESIDUES IN SEQ ID NO: (1)..(546)
MATPGLLWVTMNPRPSLPAAQFHDWYNTEHGPLRLRLPFCTNGFRYRATDGEEPEWVALYDITDMVELTRETYLALRGDTIKTPREKATMAQIDVDRRLYDTVLEQKAADYKPLELTPDTEAAGSVLIAVSLSLSSADAAKEDEFTRWYREEHIPMLSRVPGWRSSRLFVTSTIDPKAPREYLAVHEYAAQNGLGGPEYKAATDTPWRTRIMTDVVAKARRRTYQWAYTFGPAPRELSSLTSADCIGPWSSIDGKTRTLPSPTRPAVESFVTTPDGVELPYRLEGSTDPHSPVIVLSNSILVDYTIWDDFIDQFLSDPRNQNFRIVRYCTRGRQQECGDKPVNIDLLASDIIALLDALRVPKATLIGVSLGGVTVLNTSLLYPERVERFISCDTNSSSPETNRKAWNERVELAASEGAVSATTQQAIVGEQLAEITVRRWFTAESYETQPHLPAKAKELVRTNSLPGFRQSVQALCAYDVRDRMAQAQVPGLFVAGESDGVLPKTMQQMVADLKSDSELKLVPKAGHLPMLENAAAFTAVVNEYLH

SEQ ID NO: 141 - protein, 191 aa, Aspergillus niger
  ref <308>: DATABASE ACCESSION NUMBER: UniProt E2PSR0
  ref <309>: DATABASE ENTRY DATE: 2010-11-30
  ref <313>: RELEVANT RESIDUES IN SEQ ID NO: (1)..(191)
MKAVLQRVKSASVTVDGHLISSIGQGILVLAGVGKEDTEKDADSMIGRVLKAKLWPDEDDKSWKKNVQDINGEILCVSQFTLYGHLKKGNKPDFHEAADAETARKLYDYFIQRLSDSYKPERVKNGVFQAMMEVELKNDGPVGVDYRSEDAVVTIEINTQLPKKEKKEQPPGKDDGKPQTFEFKLPAELME

SEQ ID NO: 142 - protein, 418 aa, Aspergillus niger
  ref <308>: DATABASE ACCESSION NUMBER: UniProt A2QM14
  ref <309>: DATABASE ENTRY DATE: 2007-03-06
  ref <313>: RELEVANT RESIDUES IN SEQ ID NO: (1)..(418)
MYIPSVLLLAASLFHGATALPTPGSTPIPPSQDPWYSAPEGFEEADPGAILRVRPAPGNLTVVVGNASAAYNILYRTTDSQYKPSWAVTTLLVPPVAASAAVNQSVLLSHQIAYDSFDVNASPSYAMYTSPPSDIILALQRGWFVNVPDYEGPNASFTAGVQSGHATLDSVRSVLASGFGLNEDAQYALWGYSGGALASEWAAELQMQYAPELNIAGLAVGGLTPNVTSVMDTVTSTISAGLIPAAALGLSSQHPETYEFILSQLKTTGPYNRTGFLAAKDLTLSEAEVFYAFQNIFDYFVNGSATFQAEVVQKALNQDGYMGYHGFPQMPVLAYKAIHDEISPIQDTDRVIKRYCGLGLNILYERNTIGGHSAEQVNGNARAWNWLTSIFDGTYAQQYKTEGCTIRNVTLNTTSSVY

SEQ ID NO: 143 - protein, 289 aa, Aspergillus niger
  ref <308>: DATABASE ACCESSION NUMBER: UniProt A2QT75
  ref <309>: DATABASE ENTRY DATE: 2007-03-06
  ref <313>: RELEVANT RESIDUES IN SEQ ID NO: (1)..(289)
MASAAVQVPTGDPSTVPSKPTSTPSSGPHHAHTTLNFLKELPDGSHLAPTYVGVPSSYERPTTSIPVTIHDVSGHELDYTLDGNGFQFYYHTSAEKDFLDDEKIKREYYPETEQLLKDATNCSRVFIFDHTIRRPQPEGTPASQLRGPVNRVHIDQSYPASKARVEWHLPEDAPRLLRGRYQIINVWRPIKTVKRDPLAVADAHSVPDSDLVPTKLIYPNREGETCAVKPNPEFKWYYRYRQGPELVTLIKCFDSKTDGRARRVPHNSGGMSCWDSIFRAAVDVVIDKD

SEQ ID NO: 144 - protein, 380 aa, Aspergillus niger
  ref <308>: DATABASE ACCESSION NUMBER: UniProt A2QZW3
  ref <309>: DATABASE ENTRY DATE: 2007-03-06
  ref <313>: RELEVANT RESIDUES IN SEQ ID NO: (1)..(380)
MVEKGEANYPEALFARLEDSLEKAIEDGVFPGVVVAATNKTGSLRYVKAFGRSACNDTGVPLSPQSVMAFASMTKLMTCIAALQLVERGTISLDDDVGPLLPDLAQSKILTGWDKEGIPLLRERQNPITLRHLLTHTAGTGYDMTNSDLARFSACQGRHINSGETVKERFGYPLTYEPGTSFEYGCGIDWVGQLVEKLSGQDLESYMQENIWGPLGIQGITFWPAAKPDIRNNQIRMAIREPNSERVTDFTGRFLTEGVTECFGSQGAYGDMESYLEILFSLLVDDEKLLSRQTTEKLFSPQLSHSSKHSLNEYIRNHPPNAFIGIFDTESEYDWGLGGILTTQDTPSGRQKGTLIWSGKPNLFWVCPPSLRILVIGPLT

SEQ ID NO: 145 - protein, 343 aa, Sporotrichum thermophile
  ref <308>: DATABASE ACCESSION NUMBER: UniProt G2QL32
  ref <309>: DATABASE ENTRY DATE: 2011-11-16
  ref <313>: RELEVANT RESIDUES IN SEQ ID NO: (1)..(343)
MRLSWVLVGASIALAKSHKDHNFETLVTFGDSYTDNGRLGYYINHGGKAPRPGTMHDETTTTASGGLSWAQFAARDAGATLMDYAVSGAVCSNQIVSRYFDLINRTFPAILDDEIPSFQADVLFKSLYPHRTAENTVYAVWIGTNDLGWGAFLSDSQTPGKTISDFVSCVFSVLDHVYKTGGRRFVILNTVPLELAPLYALPENGGTLDSQYWNTKTKYNMTEYGQKIREYSTSVNTMLENGALVMASLKKRWPKAMVDVFDVHSLFNDIYNAPTKYLDAPHNVNSYYHQCGPAGSPCTDQPGSLNGYMWYDELHPSNKTSSIVARNFLDVVAGKSKYGTRFH

SEQ ID NO: 146 - protein, 337 aa, Aspergillus niger
  ref <308>: DATABASE ACCESSION NUMBER: UniProt A2QYC0
  ref <309>: DATABASE ENTRY DATE: 2007-03-06
  ref <313>: RELEVANT RESIDUES IN SEQ ID NO: (1)..(337)
MPPPPLTVQYKEANGSKITTDIYLPSLEQPTTSGTDTPKKYPVLINIHGGVFMLGHSRMVSMPQVDDCLSRNWIVVVPNHRLCPQVNMLEGPITDVRDLLAWIYDGGLDAFLAGAGADAALYRVDMDRVMAFGTSSGGTLALSLGYSVPRPVAAILDFYGAVHFTHPFWTQPLPDVQRTLPPLDPAFLQKIYDEFPVPTDSSISLEGQTELAGVGGKPAAKGPDFSRPRDAFALTQVANGTVLQACYPDRDMREVDPVMHVGKDFPPTFIVHGDCDTKVSIEVSRELWRVLRENGVECGMVEVPGEDHTFAMGMKVGGRTWELQREGFDFLERVIAR

SEQ ID NO: 147 - protein, 271 aa, Aspergillus niger
  ref <308>: DATABASE ACCESSION NUMBER: UniProt A5ABE6
  ref <309>: DATABASE ENTRY DATE: 2007-06-12
  ref <313>: RELEVANT RESIDUES IN SEQ ID NO: (1)..(271)
MKLPYFLLGLAGLAAASPMGLAERQLSDGNELRDGSCKPIIFIFARASTEPGLLGISTGPAVCNDLKMAKAGQVLCQGVGPAYTADLMSNALPDNTSPAAISESESLFKLAASKCPNSQILAGGYSQGTAVMDDSIKQLPDDVKDKIKGVVLFGYTRNAQEGGQIGNFPKDKVKIYCAMGDLVCDGTLIVTAAHFTYVMNTGEASQWLESKLSDTTTSSLTGSSSSDTSSSTSTGDSSSESSSAAGLGGLSGLTGLGSSTSGGFPSLASLF

SEQ ID NO: 148 - protein, 595 aa, Aspergillus niger
  ref <308>: DATABASE ACCESSION NUMBER: UniProt A2QGD9
  ref <309>: DATABASE ENTRY DATE: 2007-03-06
  ref <313>: RELEVANT RESIDUES IN SEQ ID NO: (1)..(595)
MKGLRGHNKKSFWGNTRLSDLLWPVTLLPGLISAYQPVYLGSRQSSPFLPPQIPLGDSPPLSDTHEFTLRHIFHRGTYQDPDLHRRLDITPDTRLRAVSDAGIESDVVTPNTPLVASSQPLIIERLADRRLSVIEEHLVTARSSGSAVALSPSDWVMDTLPGPNVTEKKTVVALAMMTANDYIEVPGTGDWQDIHGRFNHSGSFGWQGDGLRGHVYADKTNSTVVISLKGTSPALFDGEGTTTNDKINDNLFFSCCCGQGGSYLWRQVCDCQTTLYNANLTCIVEAMLDENRYYRASLDLYSNITEMYPNANVWLTGHSLGGAVSSLLGLTFGVPVVTFEAVPEALPAARLGLPSPPGHDSRYPQSRRNTGSYHFGHTADPVYMGTCNGVSSVCTWGGYAMESACHTGQMCVYDTVEDKGWRVGLSKHRINYVIANVLAGYDDVPPCAPEEECYDCELWKFFRSNGSEITTTTSATSTSTSTTTSRTSTCKTPGWWGCLDQTTTTETTSTSTSTSTCKTPGWFGCKDPTTTSDITSVPTITTTEPPMTSTTTCKTPGWFGCKDETTTQVIAPAATLTITEPPVTSTTTGKHLGRF

SEQ ID NO: 149 - protein, 378 aa, Aspergillus niger
  ref <308>: DATABASE ACCESSION NUMBER: UniProt A2QBH5
  ref <309>: DATABASE ENTRY DATE: 2007-03-06
  ref <313>: RELEVANT RESIDUES IN SEQ ID NO: (1)..(378)
MAPVRSVPSSFYPTPSVDMSADEQHPRFRHDPSWSYHQGVSGSMLKAFLRTFTALHMKWPLSLKPHHESDRFVLINPAASECYTGVMVDEAVKPETIGATWYPQPFTRGTSLPDDGHVILHLHGGSYILGDGRSSSCNFMAQTLLEQTPASYMLCPQYRLACNHNGRFPAQLQDALAAYMHLIHTLQIPPSRIVLSGDSSGGHLVLALLRYIVEFNRPDLLPAPKCSWAWSPWCDVPAAVDPSAWTHSTNYKTEYIPGSFPAWGAKQFLGDLEITPKVEPYVAPIWHPFVVPSPVLVITGGREVLCQDHEKLVQEFQKLPGNESSIDLVVEEKVPHDVLMIGWIMGFKDEARHCATKAGEFLRQVDASSGRKDGAPEM

SEQ ID NO: 150 - protein, 520 aa, Aspergillus niger
  ref <308>: DATABASE ACCESSION NUMBER: UniProt A2QAH7
  ref <309>: DATABASE ENTRY DATE: 2007-03-06
  ref <313>: RELEVANT RESIDUES IN SEQ ID NO: (1)..(520)
MLLKAIQALALLATILSTFYAHFANGYHIPKPVIPGLKILSITAFPLRDYTITGVQVNPIQSHTVNISFWNVTVTYTHPGWDDLIHVHVWVPLSGWNNRLQAVGGGGWAGLLDYGTLALPVYQGFAAAGSDMGHDRNPWSAESWALEDASGHVNFAQLIDFFSTCLNELSLLAKYVIQQIYGLPPAYSYWNGCSTGGRQGLEIAQRWPDAFDGILAGAPTINWAQFVPANYWPTFVMNQLGVYPSPCVMEKITDAAVASCDGQDGVIDGIIAVPSLCNFNPLSLIGMEVWCECIPSIITAEVALLAESYWAGLTAEDGTPLWYGFNQGTPWNYTICTSTDDIGNHRCHSLPDYLSVDWLQLFVAQDPDLDLVDMDQADLESLFHQSVAGYKAITDANNPDLYDFKDRGGKIIHWHGLADWQVPPNGSVDYYRRVQLRDPSVQDFYLYFEAPGVEHCGHGKGLAPTGLMESLMAWVEGGVAPEYLRAVSKNGRMSRILCPYPAIAQYVEGDPTVASSFVCQ

SEQ ID NO: 151 - protein, 339 aa, Trichoderma citrinoviride
  ref <308>: DATABASE ACCESSION NUMBER: UniProt A0A2T4BNI9
  ref <309>: DATABASE ENTRY DATE: 2018-07-18
  ref <313>: RELEVANT RESIDUES IN SEQ ID NO: (1)..(339)
MLPLLLYAAAAAAASTPGLRKLSNLVTFGDSYTDEGRLNYIFSHNALPPPGELLPVNNATSVGGYAWPRLVAQKTGAKLYDYAVAGGMCSDRVTQHFLSNINGPFPSILDYEVPAFKTDLGYRGLYPNRRPDNTVYALWIGTNDLGIDGFLGDKQVPGATIPDFVECVWKAFDGVYKLGGRHFVLLNVLPLQLSPMYASIENGGTGDNEYWGDKAAYNTTETQDRMEQYLTSANTMFATGAPYNLLVKRRWPGATVSLLDVHSLLLDLRADPTRYYTEPVNITGSWRGCGDAGCYQSANAQSTFVWYDEVHPSERTCEHVADEFISLLGGRSKYGVTYH

SEQ ID NO: 152 - protein, 311 aa, Aspergillus niger
  ref <308>: DATABASE ACCESSION NUMBER: UniProt A2QYK5
  ref <309>: DATABASE ENTRY DATE: 2007-03-06
  ref <313>: RELEVANT RESIDUES IN SEQ ID NO: (1)..(311)
MNFYPPPSTIQAEIYARIPSHLRCTGQPTEWRSGSARPASDIFLEGPVYTQNGDLYIVDVPYGRILKIDKNKEVTECIRYDGEPNGLVVREDGCLVIADYKQGILLFSPTTNTLTPLLTRRNLERFKGPNDLIISSKNEIYFTDQGQTGMTDPSGCVYRLSPDGRLDCLVSNGISPNGLVLSPDERFLYVAMTRQNSVWRLPLHADGSTSKVGLFFQSFGCAGPDGLAVDEEGSLFICHPSLGCVFVVDREGVPKARIVTAKDGGKNLTNCTFGGEDGRTLFITDSIEGNVQVVRWHCRGVVGGRVLKAKI

SEQ ID NO: 153 - protein, 262 aa, Aspergillus niger
  ref <308>: DATABASE ACCESSION NUMBER: UniProt A2R2W3
  ref <309>: DATABASE ENTRY DATE: 2007-03-06
  ref <313>: RELEVANT RESIDUES IN SEQ ID NO: (1)..(262)
MAPLKSLLLGASLATLALSTPLATDAENLYARQFGTGSTANELEQGSCKDVTLIFARGSTELGNMGTVIGPPLCDNLKSKLGSDKVACQGVGGQYSAGLVQNALPQNTDPGSISAAKQMFEEANSKCPNTKIVAGGYSQGSAVIDNAVQELSTTVKDQVKGVVLFGFTRNVQDHGQIPNYPKDDVKVYCAVGDLVCDDTLVVTAMHLTYGMDAGDAASFLAEKVQSSSSSTTSSSSDAASSSSAAGTSSSGLSGLSSFFGGL

SEQ ID NO: 154 - protein, 470 aa, Aspergillus niger
  ref <308>: DATABASE ACCESSION NUMBER: UniProt A2QN29
  ref <309>: DATABASE ENTRY DATE: 2007-03-06
  ref <313>: RELEVANT RESIDUES IN SEQ ID NO: (1)..(470)
MARVPVIGRLFWFEYLALFGSLILVLLEWVIHIITFCLPEPVIKFCYDRSKTIFNAFIPPDDPAKRGKEEKIAASVALASDFTDICALFGYEAEEHIVQTGDGYLLGLHRLPYRKGEEGRKINQGEGSIKKKVVYLHHGLMMCSEVWICLSEEQRCLPFQLVERGYDVWLGNNRGNKYSKKSVKHSPLSNEFWDFSIDQFSFHDIPDSIKYILEVTGQPSLSYVGFSQGTAQAFATLSIHPLLNQKIDVFVALAPAMAPTGLPNHLVDSLMKASPNFLFLLFGRRSILSSTTMWQTILYPPIFVWIIDTSLRGLFNWRCKNISRWQKLAGYLHLFSFTSTKSVVHWFQIIRHRNFQFYDDEIHAPLSIVASERFYKPVKYPTKNIKTPIVLLYGGSDSLVDINVMLSELPRGTVAKEIPQYEHLDFLWARDVDQLVFNHVFEALERYSSENQKGTLMEKVNGAAGTYVPT

SEQ ID NO: 155 - protein, 548 aa, Aspergillus niger
  ref <308>: DATABASE ACCESSION NUMBER: UniProt A2QS33
  ref <309>: DATABASE ENTRY DATE: 2007-03-06
  ref <313>: RELEVANT RESIDUES IN SEQ ID NO: (1)..(548)
MRYQIPLAAFPLVGLTAATAISSTNCSASAFQKIIDANGTEARVQWATYVPEGGSLNPMNYTSASEYPTGLPESCAVQVNVASEGNSSYLVGVIFPYNWNGRMLSAAAGGGINWVDMGTGTHYGFAAVSSNLGHEGIDTEGTWALGRPQAVIDWGYRAWHGATTLAKLLISGRYGSGPAYSYFYGCSTGGRQSMKNMQVYPDDYDGIIAGAPAWWTTHQQLYNLKQTTYQAPANSSHTIPEEMFPVLAAEVLRQCDPQDGLVDTIISNPEGCVFNPSTLACNSTSAPNTCLTTEQLNTLYKIYNDWVDTNQTFVYSHLFYGSESSWLDGNIGLGEESTISQQYWFLRDLMGLGDSFVWQDLDFSTVELADHLNPGNATAGQYDISEFEKRGGKFIHYHGLSDSYVSPGASTFYYDQAKSAVQANGVDDVDDFYRLFLIPGMEHCYNTPTDMNAPWYIAGADQAAYINTSTWSVPGYRDAKHDVVLAMMAWVENGTAPDSLVATVWKNITTADEVIRQRPVCHYPYQAKYTGKGDPDEPGNWEFECAYA

SEQ ID NO: 156 - protein, 539 aa, Aspergillus niger
  ref <308>: DATABASE ACCESSION NUMBER: UniProt A2QIA0
  ref <309>: DATABASE ENTRY DATE: 2007-03-06
  ref <313>: RELEVANT RESIDUES IN SEQ ID NO: (1)..(539)
MRLSLLLAGAINLVATQAIATSRCTPETFTPHLSSNASLVYAVPYGPNDTFVGPLGNYSGLPEYCAVYVNVSSSATSSYEFGLWLPINTWNKRYMAYGNGGFTGMIAFADMAPGLFYGFATVSTNTGHNSSVTEAGDAGWALNDPETRTDWGWRALHGSVALGKELTEAFYSEDISYSYYAGCSTGGRQGLKSVQMFPDDFDGVLAGACAWWTTHQQNWDLKLATYNLPNNASHHITETQVDALATEVLRQCDEVDGVKDNIIMNGYACDFRPETLLCDGPSANKSTCFTADQIDTVYKIYSPWVETNDSFVFPSFAYGAETQFAQMIMTDDDEQDSPSGIAYPRDFVYNDANWPWQNLDYSTIELSDRLDPGNATAGDFDLRPFKNKGGKLIHYHGFADGEIPTGSSIYYYKQVQKMLTPLGIDLDDFYRFFLIPGMEHCLDSVHDAPWYIASANQPGGLTGTNVWGVPGYRDRKHDAILALMAWVENGIAPDELIATKFVDDTPAEGVQAQRPLCVYPKEAKYVGGNWNKTTAFECR

SEQ ID NO: 157 - protein, 317 aa, Aspergillus niger
  ref <308>: DATABASE ACCESSION NUMBER: UniProt A2QPC2
  ref <309>: DATABASE ENTRY DATE: 2007-03-06
  ref <313>: RELEVANT RESIDUES IN SEQ ID NO: (1)..(317)
MTGIPTVTARPWTQRPRAENSTTNPTYFFTLCAQPFPSTPPTHITNNIDDEGIGTTTNGPNWIGYLTTTENASLVLSYNLAAGGATIDNALVPAYPGDLASQFRLFEDVYADKPASAPWSAEDAVFGVWIGINEYILPPPPPPPPPPPPLLLHSPDCPYTGGGCYIGNAYYSTDAETYTPKLISRLESLVEEVYKNGGRKFLFLNVPPTSRSPLFLEQGEEVVKQHAEYLSVYNENLEGMVDDFTKKKGDVTTVLYDSWSFMTKILDDPTAYGFPDATCINDDGTSCIWWNNYHPGMKYHLLQAEDMKPKLRKLGGW

SEQ ID NO: 158 - protein, 386 aa, Aspergillus niger
  ref <308>: DATABASE ACCESSION NUMBER: UniProt A2QZB7
  ref <309>: DATABASE ENTRY DATE: 2007-03-06
  ref <313>: RELEVANT RESIDUES IN SEQ ID NO: (1)..(386)
MAFESLAFHTKLRILRWLTRLLAWLDRKRHPVSTITPTSQISIPSTLSASPGNFDLHIYHPPGYNQSSTKKGEALYPVVIVLHGGGWCVGHARHDERFIETVTQRGRAVVVAVNYRLAPEHAYPVPLLDCVDAMLYIWKNATAMGVDKHRTFITGFSVGGQMAFASQYWLAQAIAQHEHPQIDRASLGTVKAITAFYPPMDLTKTRAQRAASNPAFMALKKKPASSSKLIGDIFDRAYFWNLPDTIDKSQICISPGLAPLEMMSRALPNHIYVKLAGLDPLLAEGKAAAAQFEAAGKHVECEVVENVPHYWDHLGKTEHEKTLRSRVYERAADEMEEVLRNVNKLQGKLFGPRTWEIGTSTSSLIQLVAVEYSSIRGDACFKICQY

SEQ ID NO: 159 - protein, 289 aa, Aspergillus niger
  ref <308>: DATABASE ACCESSION NUMBER: UniProt A2QBP1
  ref <309>: DATABASE ENTRY DATE: 2007-03-06
  ref <313>: RELEVANT RESIDUES IN SEQ ID NO: (1)..(289)
MKSFIALSLLATALGAPTATHQARQFDLSSLTSGLSALTSGSAASSGSTGSTGSETTTGSSGLSALASLFPSSSTSSTTGSTSGSGSSSSSDGLSSLMSMFSSSGSGSSTENGVTQHSGSCKKLTFIFARGTTEIGNMGTVVGPEVASELATLTGNQVTVQGVNYPADWEGNVSLGSSGGPTMASYVKEALQQCPNTKVVLGGYSQGSMVVHYAANQLSADQLSGAVLFGDPLKMEGVGKLSSSKVKEFCASGDPVCENGMNVMAHLTYGSDAKEAAQFLVQAAGVSSS

SEQ ID NO: 160 - protein, 1391 aa, Aspergillus niger
  ref <308>: DATABASE ACCESSION NUMBER: UniProd A2QT10
  ref <309>: DATABASE ENTRY DATE: 2007-03-06
  ref <313>: RELEVANT RESIDUES IN SEQ ID NO: (1)..(1391)
MDLLNDDSAALLQEALDTLDEDPVDDLDPLDLDLDNSGASISLDDLLDNTSEPPDLDPLSLVDGEETYDGHSSSSTDLLEEKVTAVRNGENPLMTSVSDFTSILSRTGIHGPRHLQTYNLKRRAVKIGSGGQFTVYKEIPGRFFGNEGLVIKRVKVFLSREGSGSFASGSDYRNRLRSLELEVLALSNPYLRNHRNIAKLVAWGYDYPYPDTPVPVLFVEEALMTLTDLLKIDNERLLGPQPLDVKYQLLLDAVSGLEALQRLHIVHGDVKPDNILIYKDTAGSDNVPLCAKISDFGVCVDLESPEDKLTIDSYYGTEDWRAPEASDLSRWEGAAFDPEVMFRFDSYSLGLLILSTFINRGEPVKLKSPGEEPIEVALFMLREDPSITGPLRMQLGKALRQLLATDPWKRSLASPELLKFDSPAFASWLAVAQDTRKVTANVGIIDPAHNQGPRFWYRLDPSLLADLEQQFAESQSDQSLRHAGDVLLGMAQCITGAKPSYLERLLTYITEAARSGYSPARAVYAQVMHAHGQMPAFDEQTLDKWLLQAVSEGYFFERPSSRVTKEQLQAARQKYRDAGGFCADPFTRKPTILDIAHDRNRAEEWLTADKRFVDIDGNTLLHVAAALGSIDVVQWLVENSKMPVDVPNDNGETPLYKACQAGQTDTVHYLLDHGAAASITTRRDKLTPLHWLFMFPESSTSAIATRFVKEGGADVNALMVPERTEEGAYAARRNFMAHYPFELPMGAPFHWAAFARSIPAMEVLLELGADINAMYHKSDTATTALGLASWYGDLEVIRFLLSKGANGKAKDARGRNMLHLMTFHQPEYHGPLRQAWHYWIRHGSWDTHLQQMTDLVASLTLAGVNIEDRDEVYPRTTAVVRAAEDGVWNGGALCALINAGADVDGPRGTSKDTVLHQWARITGPRLAYTDSYLYVLQEIVSGMACLDIRNDYVEETPLHLLVTIYHSEEEFRSACDIFFAHDPPPDVNLGDRQGLTPLLIAADTNQITQDPEQRATYLISKGADVGARTRENKDVFCLLANNKTLSDQQSHDIICRLLTHMATLEGCSIAQVYKKHYLPQRGALLTLGTAAMAGRVKTTALLLDVGLDEVINNVVNPKDPATVLDNTISSAEQSRHMHLDLLAAYSPGAPRARALASQTVYDPRQGPPVRATEAYWGLPEVLQLLRGRGAKRACELVPSSHPSHGTIDHPDVWDITHMYWVGFTPETQINRERWEVVYQLSRLPSIGWRETVIDSLRDMYESDTWWPDLAMLEASINVINKGEKNLASNPVLTLPTAPSDTHTEVMDIELLMQMLRMLVTVRHGEDDVQKTDDIGDTSTAMSRWVKIREGQKYDRSPTSSEALMIPEVKLVWEGTEGTGFRLGPKRVRQVD

SEQ ID NO: 161 - protein, 584 aa, Aspergillus niger
  ref <308>: DATABASE ACCESSION NUMBER: UniProt A2R274
  ref <309>: DATABASE ENTRY DATE: 2007-03-06
  ref <313>: RELEVANT RESIDUES IN SEQ ID NO: (1)..(584)
MRNLVPLAAAVGAAHAASLSDICNDAYIKAALPADGTFQGISMISSSVSTTIHSNVSISSSNFYPAATISYCDVTFNYTHIGRNDRVALTYWLPAPADFKNRFLTTGGEAYEINEGSGTSGSLPGGLMYGAVAGLTDGGFNGQSFDDVFLLANGTVDWQNTFMFGYQGIHEMMEIGRQLTRNVYNTGDDKVYTYYQSCSEGGREGWSQAQRYGYDYDGIIVGAPAFRFAHQQINHLVPNVVEQTMNYYPPPCELELIVNATIAACDPLDGRADGVVARSDLCKLHFNYTSLIGAPYYCAASSGGSSLGLGFSKRQSMSSTPAQNGTVTKEAVELVQTLLAGLKDTQGRQAYLYFQPGADFDDAETTYDSETGTWGLSIDGNGGEFVAKFVNLQDVDSLTTLDNVTYDTIRDWMQMGWTMYEDTLMTHNPDLSVLQQSGGKILHFHGEQDPSVPTASSVHYYEAVRKIMFPNESLNTSAAALGEFYRLYLVPGMAHCGTNSEQPNGPFPQTNMAVMIDWVENGVVPVTLNATVLQGENEGEHQQICGWPLRPLWSNNGTTMDCVFDQASYDTWIYDFDAYKLPLY

SEQ ID NO: 162 - protein, 536 aa, Aspergillus niger
  ref <308>: DATABASE ACCESSION NUMBER: UniProt 2QUE3
  ref <309>: DATABASE ENTRY DATE: 2007-03-06
  ref <313>: RELEVANT RESIDUES IN SEQ ID NO: (1)..(536)
MKSTTPLLAAAGVAAAKNCSVDTIAKYLPKNATVFYANHYEKGYNFTPPIEYNYGLTSDPMGISAYELPLAGCVAQANISLPNNTQHSVGLVLPDEWNGRFMAVGNGEFAGSVGWSSIINTMWYGFASVSTDTGHEGNNGSFGYHNEAALTNWGYRALHDAVVNGKKVTEGYYEKDISYSYYRGCSAGGKQGFKEVEMFPDDFDGVVAGAPAWWTSHQQLWNVLTAIWNLPETADYHVSDAQMTAVQDEILKQCDPQDGLKDNILQNPFGCVFDPVPVMCNATSSNDTCVTPAQLKTVNKLFNPWYEANDTLIFPGYTLGTEVGAPSLDDDFVTYIQYMLQIGGDWTWKDWNPDLVALSDKINPGNATADDFDISPFYKKGGKLLHYHGYSDPSIATGSSVYLYNHIQEALRPQDIPIDDFYRFFLIPGMEHCTGTPSDQDAPYYMNGDSQAASLSGTVFGVPGFNDPKHDLVLAIMNWVENGTAPDYLIPTKFKNDDVADGVDKQRPICPHPQLAKYKGSGDVDKAENWYCGTLY

SEQ ID NO: 163 - protein, 344 aa, Trichoderma citrinoviride
  ref <308>: DATABASE ACCESSION NUMBER: UniProt A0A2T4BCL7
  ref <309>: DATABASE ENTRY DATE: 2018-07-18
  ref <313>: RELEVANT RESIDUES IN SEQ ID NO: (1)..(344)
MKLFSTLASGLVAAAGLALAQDSAANGTISKGPFPADLNGSNFTYPYPVHVFSFASQQQTLQMAFMDVKPTCAPNGQTAVVLHGKNFCAPTWNATITALAGAGYRVVAPDQVGFCKSSKPDNYQFSTNQLMYNTRGLLNALGVGNVTLVGHSFGGMLATRFALQYPATVDRLVLVDPVGLEDYVEKGVPYTSVDYNIAAEAAQTFDAIKAYEQQVYYVGQWQDSYTVWVSMLNNIYYGSRRAQFIKNQGQIVDLVLTQPVSHYFGDVVSKTLLIVGDQDHVAIGGNWSPPEVAAKLGHFDVLGPQVCGEIPDCTLYQFPDLGHAPQLSAPEQFEKVVLDWLAKE

SEQ ID NO: 164 - protein, 327 aa, Aspergillus niger
  ref <308>: DATABASE ACCESSION NUMBER: UniProt A2QK82
  ref <309>: DATABASE ENTRY DATE: 2007-03-06
  ref <313>: RELEVANT RESIDUES IN SEQ ID NO: (1)..(327)
MHTPYLLGALAALAATAVGAPAEHIKKRESRTSAPSGCLTVGSDGTYSTIGDALDALGSSTSSACIYVASGTYEEQLTIDYAGNLTLYGETTDTSTYKDNVVTITHTISSSDAGSLDKSATVNVVSDGFSMYNINVENGYGEGAQAVALVGNADQLGFYGCQFSGYQDTLYVKAGTQYYSNCMIEGAVDYIFGDASVWFGECDIVSNGAGAITASSRETSSDSGWYAIDNCNIKAASGVSLTEEVYLGRPWRVLARVIYQNSVLSDIINPKGWTTMADGATPLYYEYNNSGAGSDTSDREYETSISAAVDKTTVLGETWGDWIDRSY

SEQ ID NO: 165 - protein, 248 aa, Trichoderma reesei
  ref <308>: DATABASE ACCESSION NUMBER: UniProt G0RH85
  ref <309>: DATABASE ENTRY DATE: 2022-05-25
  ref <313>: RELEVANT RESIDUES IN SEQ ID NO: (1)..(248)
MRSLAILTTLLAGHAFAYPKPAPQSVNRRDWPSINEFLSELAKVMPIGDTITAACDLISDGEDAAASLFGISETENDPCGDVTVLFARGTCDPGNVGVLVGPWFFDSLQTALGSRTLGVKGVPYPASVQDFLSGSVQNGINMANQIKSVLQSCPNTKLVLGGYSQGSMVVHNAASNLDAATMSKISAVVLFGDPYYGKPVANFDAAKTLVVCHDGDNICQGGDIILLPHLTYAEDADTAAAFVVPLVS

SEQ ID NO: 166 - protein, 630 aa, Aspergillus niger
  ref <308>: DATABASE ACCESSION NUMBER: UniProt A2R199
  ref <309>: DATABASE ENTRY DATE: 2007-03-06
  ref <313>: RELEVANT RESIDUES IN SEQ ID NO: (1)..(630)
MSERVQDKSGKQINEGDYVYTKYRGGSHEGEVDKVVTDDAGAHEEEVANPPKMTQAWGTVTVLWFPHSELVAEHKRCLCFPIALGWPADWVTGHTKTATGSWPSPGQDRNSMTKEYEARFAGYIHQHFLSSGSTFTLGPLLDSPSCTLNLHNMRLSALTRRLLYGVFLSPVCLCISIPQQPSHVPISDHDLVSVLSNAVKDPMVDRRVSSVASDIMLGLATNENLQHPGNEQLQAALKKIEAIFTKKSSSTMLDLAKDIVASGLVPPKILAFLNGYLDAKINSAHNLNPDLKSGSIYPSKATEDAPYSIPEAALREAIHMPNLFSGESNSGRKPVILVPGTAAPAGTSFYYNFGKLGNAIPEIDVSWVNIPQASLGDVQVTAEYIAYSINYISSLYRSKVNVISWSQGGLNTQWALKYWPSTRDSVEDFIAISPDFRGTIETRLVCPWLAGIMCTPALWQQGWDAKFVRTLRGFGGESAYVHTTTIYSSFDEIVQPMYGDQASAILQDARGVGVSNNHLQSICAHEPAGGMYTHRGVLYNPLAWALTIDALTHDGPGRPSRVNVTTVCQQSIPPQLGLDDLLGTEGLLLVSLSETLRYRPKTFAEPDILGYAASAPGVGGEIWDLKDEQF

SEQ ID NO: 167 - protein, 397 aa, Aspergillus niger
  ref <308>: DATABASE ACCESSION NUMBER: UniProt A2QEW9
  ref <309>: DATABASE ENTRY DATE: 2007-03-06
  ref <313>: RELEVANT RESIDUES IN SEQ ID NO: (1)..(397)
MLLHGLLLALQAILASSAAITSPSSNHLSTAAREKCQTTLQCPPGTLIVSNTHPQLSNFTTLQAAINALPNDNSSQTILLLSGSYNEQVNITRSGPITLLGQQPDRAALTDPARNTVNLTFAGANSDSTGDIDNVWFSVMVVAPTLDASLTGSGTTGYPVPADTPFGNTDFRVYNIDFRNTYAPYSAGPAHAISFSRSNGGFYYCGFYSYQDTIYIGKLGSAYMYKSILAGQTDFLYGFGTLFIQSSQIVLRSCGGGITAWKGTNTTVRNNYGVYIHDSTVNAANTSIAEQIKGSCALGRPWNSLHRSIFANTYEDGSIEPSGYINWEDRWSKNETLMAEYKAYGPGFNLTGRRESEVSVLLSSSEEERYRDPSRLFLFEDGREGNVAWIDWDVVSS

SEQ ID NO: 168 - protein, 782 aa, Aspergillus niger
  ref <308>: DATABASE ACCESSION NUMBER: UniProt A2QIE4
  ref <309>: DATABASE ENTRY DATE: 2007-03-06
  ref <313>: RELEVANT RESIDUES IN SEQ ID NO: (1)..(782)
MSILHDSSLVRPQCHVKGKPRSLETSNRPRRSVLKSVSLPSLSAVVKNSLTWAGDTWGSYGNGQSPKERRLRAAVDERKEALYLKKRNAVTYEEWRDAASELDELENNSAWKQTFECPDYDPHLVLDRLKQLDDARINCDISRMLFLIRTSLSRDLGNMSNASLYKHAHLGTKNLIDQYIDTALETILSLVELADRNRCDVVESRYILDQLLAARQAFGRSALLFSGGATFGMNHIGVLKALWQANLLPRIISGASAGSIVCAVFCTRTEDELPALLDSFTEGDFAVFGEGTEEDTILQKTARFLKYGSFLDISHLAKVVRNWLGDITFQEAYNRTRRILNICVSSAGIYELPKLLNYITAPNVLIWSAVAVSCSVPVVFSPYALMAKDPLTGEPVPWSDLHRQYIDGSVDGDLPMTRLSEMFNVNHFIVSQVNPHVVPFLPKDDGPDPYLENTFTASRWLRAITYLAKDEILHRMTVMSELGIFPTSLTKTVSIVNQKYSGDINIYPEIQYSRIPVMLRNPTTEFMLEACLSGERATWPKLGRIRNHCAIELALDLAIQKMRARVAFSPSRVHARTDNITGHSIESLDSSGGRGRLLNRRSSYNHEIEKIKQARNDAGRRTRPFLQRSRSVLLSEQTHRIDSVASARLDQAVQRRRQNNLSQPFNIDDGSYSPSSGSDEYSEEASPRTRVPLERHVSWDPSSSDDPPSDEATPHSSTQSPHPSSPIHIGRVASQRAPVWTPDLSAHALPTTPEPSFPPSPHHLRMTPKAYVSNPTSRNFYN

SEQ ID NO: 169 - protein, 1826 aa, Aspergillus niger
  ref <308>: DATABASE ACCESSION NUMBER: UniProt A2QY19
  ref <309>: DATABASE ENTRY DATE: 2007-03-06
  ref <313>: RELEVANT RESIDUES IN SEQ ID NO: (1)..(1826)
MTDSTVNPSEERGSENNSNRYYSRQTEPMSLDSSKLSSPLPSPCSTKDDADRANIADGGDQVEATPTVRGVGDAHFDTKGKSRAEHAGDSGEEKTSNASPTNKAASLSLRQPNDATANQQNSGSRKSPTSALGSSASPRRPSVQFTQDTPDVDAAEPSQSRPPSVKGDDVDSGLKGRQSLLTKLKSFAASPSFTSHTRSASGATLNDFRPTNNELATPGSERGEFRFPNTLEEEGSDIDADAEESAGEQRARQKKQKKKQPRRRQQDDSVPPSQPNTPKFTSRPSFHLPSSFSPFENYRPNFFPRRGSTGDFTPQQREGVSEDEGRDRLNRDTAWRRKSAWLANARGLTYSGRQIDAPANQEERRPSNLRRLTGLAGPSENAEGTAPPWRRHRADRGSSLSAQRWRQIKAGLKLIGQRRKVDNTVDHAKSAELLAELTSGVPAALILASMFQRDEHGSKRIPILLEQLKVRVTDSKIDSHSGDRHLVFRIELEYGSGMTRMKWIIYRTLRDFANLHLKYKLHFGTQKYIQLRNTEGAQNLPRFPRSAFPYLRGVRGLESDMEDEEDEGGYETAAEATSGNERAAKKQQQAHRRSSGGLSRRQSTVTNPEAEGAAGPSGLPEAGQASKKESYPERQRKKLESYLQKLIRFLIFKPDSNRLCKFLELSALGVRLAAEGSYHGKEGFLVIQSSKGLDFRRALTPGMVKKRHSPKWFLVRHSYVVCVDSPEEMNIYDVFLVDPFFKLQTQKVSLRNQKAKEFAKSATESARHPQHHTLRLENSERKLRLLARNERQLHQFEDSIRFMVNNTPWARPNRFDSFAPVRHKCFAQWLVDARDHMWVVSRAINQAKDVIYIHDWWLSPELYMRRPAAISQKWRLDRLLQRKAREGVKIFVIMYRNINSAIPIDSEYSKFSLLDLHPNVFVQRSPNQFRQNTFFWAHHEKLCIIDHTLAFVGGIDLCFGRWDTPQHLLTDDKPTGFETPDGPKDADHCQLWPGKDYSNPRVQDFYDLDKPYEEMYDRNVVPRMPWHDISMHVVGQPARDLTRHFVQRWNYILRQRKPTRPTPFLLPPPDFEPADMEALGLDGTCEVQILRSSSMWSTGTPDITEHSIMNAYVKLIEESDHFVYIENQFFVSTCEIDGRKIENSIGDALVERITRAAKNKEAWRAVIVIPLMPGFQNTVDSEGGTSVRLIMMCQYRSICRGETSIFGRLRALGIEPEDYIQFFSLRTWGKIGPQDQLVTEQLYIHAKCMVVDDRAAIIGSANINERSMLGSRDSEVAAVVRDTDMIWSSMNGRPYLVGRFPHTLRMRLMREHLGIDVDELMEHSMATEEELRRIEIVEEGSKPPESQLDSESLMLEKKDERDMMERRHRLQDEFLSRSEDMHSFNHDVDWEQGNNPNLKSNRKLTADPRVTSNAEHRKDVDGFGADNLTKAVGAGLGDARDSEFLGPRTEVLISPVASEGKGTVQQPKQPSQRNTHRANAGADREGNHSLSPVVEHGNEGAQVVEGLPAVRHPALPVEQESESSHSGVQTASREKHDPIKSAHLFSSDVKHVFIDKDCMRDPVIDCFYLDTWQAVADKNTKIYRNVFRCMPDSEVKSWKEYKEYAAYADHFAEMQSQHSTKAYQPTSQRQTGPPGTGASMAGAAAGLKHTLSVHAQSAEGAKVEAKDSPVEKNDVRSTEAGQKSDTHNAEHRTSDGLVPVNEKSTTKGADGTVTGHMPNGRHEESGSSGEDQEKQRSDPPLVDYSEALNRNATGQSRRRRRRATTLGSKREFHATDEVMDKQRAEELLNHVQGHLILWPYDWLEKEEQGGNWLYTLDQISPLEIYN

SEQ ID NO: 170 - protein, 331 aa, Aspergillus niger
  ref <308>: DATABASE ACCESSION NUMBER: UniProt A2QHB7
  ref <309>: DATABASE ENTRY DATE: 2007-03-06
  ref <313>: RELEVANT RESIDUES IN SEQ ID NO: (1)..(331)
MVKSILASVFFAATALAASRMTAPSGAIVVAKSGGDYDTISAAVDALSTTSTETQTIFIEEGSYDEQVYIPALSGKLIVYGQTEDTTTYTSNLVNITHAIALADVDNDDETATLRNYAEGSAIYNLNIANTCGQACHQALAVSAYATEQGYYACQFTGYQDTLLAETGYQVYAGTYIEGAVDFIFGQHARAWFHECDIRVLEGPSSASITANGRSSESDDSYYVIHKSTVAAADGNDVSSGTYYLGRPWSQYARVCFQKTSMTDVINHLGWTEWSTSTPNTENVTFVEYGNTGAGSKGPRANFSSELTEPISISTLLGSDWEDWVDTSYIN

SEQ ID NO: 171 - protein, 231 aa, Sporotrichum thermophile
  ref <308>: DATABASE ACCESSION NUMBER: UniProt G2QH51
  ref <309>: DATABASE ENTRY DATE: 2011-11-16
  ref <313>: RELEVANT RESIDUES IN SEQ ID NO: (1)..(231)
MKFLSLLTAAGVAAALPTSPAEVSSAGEIEARQLASTRNELENGDSANCPKAIFIFARASTEPGNMGISAGPNVASVLEAAYGDNIWVQGVGGPYRAGLADNALPAGTTRAAIDEAKRLFNLANTKCPGAAVVAGGYSQGTAVVSNAIAELRGTGTATQEQIRGVVLFGYTKNLQNGGRVPDYPTDRTKVFCNVGDLVCSGTLIVAPAHFLYTAESLGEAPRFLQSKIDAT

SEQ ID NO: 172 - protein, 621 aa, Aspergillus niger
  ref <308>: DATABASE ACCESSION NUMBER: UniProt A2QTZ0
  ref <309>: DATABASE ENTRY DATE: 2007-03-06
  ref <313>: RELEVANT RESIDUES IN SEQ ID NO: (1)..(621)
MATPRMGGVVAAVTVAIVLFAIYLSPSTDVIVEHINDYYNVVFPKAPVSSPTVYDPHRGIKYIGTLSNGVEHFQNIFYAEEPTGPRRFAPPVPVRPPKGSVIDATQSGAWCPQGTGDILPFTSRVTNISENCLSLRVARATGVKIQDKLPVVVWLHGGGHALGSASDILYNPEGLLQEAVAAGKPLIYVGINYRLGFFGFATSKAMIAKKQTNAGLRDQRAALEWVRGNIEAFGGDPSRVTAIGQSVGASDIGLHLTSFNGTKGVPFRRAIMMSGAPGVNFNSDPSLVSENTANIAREVGCINTNDAESLETLECLQRIPFGTLTNLSVTASRAARPPFGEGFFYPTIDGDFLPARPSELLRAGNFVKDIPIIASWVTNDGAWYAAPPTSTDEEVLASFGLWLSKLSTSTKARLLDLYPITDFAHMIRESYDGPISPQYYRAAQMNRDIWFTCPVLDFAWQYAQKGGLSPSKVWLYEHNATRYAPVFEIMGVPMWRVAHLSDIPYVLNNANLEGGADNSPEQMKLARKVSRKVIGFAYDASPSEAWAAAFSGISEQGLSKDSPDQLSIQTFGGPMGSRAVTVRKGADTSGSTEAEKALLWERLFDRCEFINSAQMRAEAGV

SEQ ID NO: 173 - protein, 405 aa, Aspergillus niger
  ref <308>: DATABASE ACCESSION NUMBER: UniProt A5ABC0
  ref <309>: DATABASE ENTRY DATE: 2007-06-12
  ref <313>: RELEVANT RESIDUES IN SEQ ID NO: (1)..(405)
MACAGPDRDLPGVVAMVVDKNGDQVFAHAAGQRGHGHDHLGPMQIDTLFWIASCTKLITGIACMQLVERGVLTLDDTEIVQRHCPELRHVRVLQPDGRLVEKQRDITLRMLLSHTAGFGYSFIDANLRDHNRPAGYNVLGTKEGFLQPLIHQPGEAWEYGISVDWAGFLLERVTGQTLHEYMQQHIFQPLRLTHISMIPNEANQAKLACMHQRVSNGQLYVRKEHPLQRSLAIGLYPNDSPSSFCFSGGAGCFSTAHDYYRILSTLLNNGTCPLIGTQLLSRETVDEMFRNQIPHLAPLNGKHMPAAKPELTTAATGLQPTVDGNRQGWGLTFLLSGGDTGRSIGTAQWTGLPNLRWWCDRENGVAGIFCAQILPFGDLKAFSLAEEIERQVYAGLSEAQRGRPG

SEQ ID NO: 174 - protein, 512 aa, Aspergillus niger
  ref <308>: DATABASE ACCESSION NUMBER: UniProt A2QN56
  ref <309>: DATABASE ENTRY DATE: 2007-03-06
  ref <313>: RELEVANT RESIDUES IN SEQ ID NO: (1)..(512)
MLLRLCVIATLFVTQGVAVPASPATRDTNGEGLLVQTSSGPIQGFFNQTAPDVRQFLGVPFAEPPVGDLRFSSPVKKQPNGTVNAFALPSSCIQQTSNSSTIYTTYETGFLISGGDSEDCLYLSIWAPRIENIQSQQRPLPVLLYIPGGGFTSGGEASLYKIPDKWVQRTQSHIVVIMNYRVNVFGFPNAEGLSEQNVGFLDQRMAIEWVAANIANFGGDPARIALWGQSAGAGSVTAYSYGYPEDPIVAALIADSGAPGIIDNDDYAHTNFTFLASLVGCDGLSSTEELSCMRNVSARKLQTALSTYSGSPSISFKPAIDNKTAFANWTQRAVEGKIAKIPLITGSNTNEGAGFVSFTPTGPGKSTLFNITESIIACPVADEVKNRNFANLTTYRYQYAGNFSNISPLPWFGAYHSSELPLLFGTHYEYGGPSTQYEWDVSYAMEALWLSFAEDPSRGPVRLAVGNAAANPNNGSYFAWPAFEQGSDNLLVFAEGETMMQLVGAGRIDDYC

SEQ ID NO: 175 - protein, 617 aa, Aspergillus niger
MNASGIMGYQLPGVVILMLLLGSTALALLLGSRSVSAGSLKDIKHVVIFMQENRSWNRNSTNHVQYFGTMAGVRGFNDPNVQINPDGLPVWYQSVCFGVFFKGYKGGNTTDAIQCMAAGDNGYEDSHASLNGGLNNHWARNNTPWSWGYFKRDDIPVHYAIAEGWTTGDMYQESQVTSTNPNRVTLVSGSVNVPGGPQKPDQGGVYIDNNVTPVYEEAGVSWQVYQDKDNFDDNPLARFEQYQNASSSSPLVEKGMAFLGLETFYEAAANGTLPEISFIVGPAELSEHPPYMPKDGAWLQKKVVDAVTSSPEYSSTLLMISYDESGGYGDHVIPFHSPEGTPGEWMEDPYGVFGKLYVGPGLRVPFYMVSPWTRGNRVFTERADHNSQILFLEQWLTARGYENVQTPEMVHWRREHMSNLVNALDLDHPDISLPKLPEAEEPEMSSGSYVGTSNCEATFPEPRPPVPYGKQNVTESLFFEDGYKEVVGYLTEGRYLVFEKSGYALTNTGNTTRLSSSAARSDHSDKKQRWVIHYSSGEESQIFKISSALDGKWLGPHGSLLPAGRRGDAAEVKITFLGNGHGYGLQMATRCGVSPTTKKWLRTRDRAEGYKFIDDWN

SEQ ID NO: 176 - protein, 1115 aa, Aspergillus niger
  ref <308>: DATABASE ACCESSION NUMBER: UniProt A2QZR0
  ref <309>: DATABASE ENTRY DATE: 2007-03-06
  ref <313>: RELEVANT RESIDUES IN SEQ ID NO: (1)..(1115)
MFISLNVLAAPAVFIAAAVATVPTHVHATGDTRSDDTTVFFENDGNWTSHGTKPSALFVNTPSSYAGANAVCTEQNETLLSCKEYVNFENLFSYQQYLGRITADQLFWSSCSSSSPTSWRGVVQSSTNSSSDLPFLCTNSAPLVDKVDTDYSGFPRVNVTYNGTTFEGMRDHMAFRFAGIRFAQPPTGDLRFQPAQPWNHTIPYVNATSYGPACLQFGYFDQLVWSEYVTHLEYLRNTAYFSDPWGNSEDCLFLNVWTPHIPSSDSLDPDNGKPVMVWIYGGGDTQGSAADSTFDGASLASRSDVVVVSQYRVNIFGLLALDDGELNGNYMMTDKIQALRWVRQNIAGFGGNPKNVTIFGQSAGGSSVNDLITCPAIMGEDLFQNGIVQSGKSNVATAEVAAAYALPYIGEFCNGTATQRASCLRSLPAETLLDITNNSISWYTVIDGHYSADYTQARYALGAQYINSVNVLTGNMLEEYQSLATTTLWPSMSNFSEALEILISDAAINEAQAEAALNSGLYTITNNTVYNGSTTYTSVYNASVHLGTEGQLYCDGTLLQWIAAASWAFKSHWFYIHNRGYALSYYDFYDLCTFPVGEPDTPYYRCHSSDLYEVFGTYYIFDQPVRVPEDIYYTNAVQDMWGAFARTGNPNVDPAYLKARSYDSTIDFFFGFEWPQFTVTSPRVASLQYPGPEVSSLPYQEHCEVLLPYVTNPSAPSASAQGQILFLYFGSENSFSGRWWCKLRWSREQPHNREEAKGMTIITIPCCIRRPWLHRQSPTPSLLLSAFRTHFIQDMDILTRAQTGFLSWRHGTPLSSGAYASPKFQSWHTFDPVQSWMATWSDIDTNSPADPAGSGDISRLVLLTWNIDATSPQTEKRVTEIITCIIGLDPRVDIIFLQEVSKPALQQILKDERVRELWLSSECDDTSWGDQSFAVMILLSKARFTTNAAIGPIWRVKFPSHFARDALCCDIFVPSPKEPKPARIRLVNVHLDSLPIKPSHRPKQVSIATSLLRVAGQGLVAGDFDPVLDEDNGLLEKNGLVDAWATLRPEEPGFTWGLDGKQPFPPNRLDKIGILRLRSHEIKTLEPKPISGSSDDEPLWSDHHALIYSFGLVNE

SEQ ID NO: 177 - protein, 248 aa, Trichoderma citrinoviride
  ref <308>: DATABASE ACCESSION NUMBER: UniProt A0A2T4BJB5
  ref <309>: DATABASE ENTRY DATE: 2018-07-18
  ref <313>: RELEVANT RESIDUES IN SEQ ID NO: (1)..(248)
MRSLSILTTLLAGHALAYPKPAPQSLNRRDWPSINEFLTELEQIMPLNDTVTAACDLIGDGEDAAASIFGIPETENDACGDVTVLFARGTCDPGNVGVLVGPWFFRSLQSDLGSRTLGVQGVPYPASVQGFLSGAVQPGIDMANQIKSVIQSCPNTKLVLGGYSQGSMVVHNAASNLDAATMSKVSAVVLFGDPYDGQPVANFDAAKTLVVCHDGDNICQGGDIILLPHLTYAEDADTAAAFVLSLVS

SEQ ID NO: 178 - protein, 355 aa, Aspergillus niger
  ref <308>: DATABASE ACCESSION NUMBER: UniProt A2R775
  ref <309>: DATABASE ENTRY DATE: 2007-03-06
  ref <313>: RELEVANT RESIDUES IN SEQ ID NO: (1)..(355)
MVKGGVAFLAFAGPALAGVIARAWCGYWHGPPPPPPPIQFPTGTAPQPKPTTSHGTAPIKPTTSIGTAPIRPTTSIGTAPIRPTTSIGTAPIRPTTSIGTAPIRPTTSIGTAPIRPTTSIGTAPIRPTTSIGTAPIRPTTSIGTAPIRPTTSIGTAPIRPTTSIGTAPIRPTTSQGTAPIRPTTSSGTAPIRPTTSSGTAPIRPTTSSGTAPIRPGTTETTVGPIPTNGTTVIPPATVTTHTPVPIQNSTVIPTQSTQPPFQNTTVPVVPVVPTQSPQPPVQNTTVPVVPVVPGQSTVPAVPGQSTVPGVPGQSTVPGVPGQSTVPGVPGQSTVPGVPGQSTVPAVPGQSTVPGV

SEQ ID NO: 179 - protein, 581 aa, Aspergillus niger
  ref <308>: DATABASE ACCESSION NUMBER: UniProt A2QW25
  ref <309>: DATABASE ENTRY DATE: 2007-03-06
  ref <313>: RELEVANT RESIDUES IN SEQ ID NO: (1)..(581)
MRSHQLWVTTLALTGAVQATTLQDVCTVSFARNSLPADSVYPGVSIDRSSVTAVAAYNVSSTDQVYWPDATFDYCNVTFAYSHLGRDDRVVVSYWMPAPSKFANRYLSTGGSGYDITLGSTSLPGGVMYGAVAGTTDGGFGGFENGSDDVWLLANGTLNYETVYMFGYQAIHELTVIGKELTKRFFNTSSIYSYYQGCSEGGRDGFSQIQRFAEDFDGAVTGAPGFRFTFQQMQHLWSPVVEQTLDYYPPPCELEKIVNETIKACDALDGKEDGVVSRTDLCKLHFDANSTIGEPYSCGASSLTTYKRRKRSETYELPAQNGTVSAKGVEVAKEILRGMHDTKGNQVYFSYQPSAAFSDAETHYDYDTGSWTLDITESNSEWVEKYINLLNATEMPTLRDVTYDNLKEWVRIGWQKYDDTLQATYPDLSPYSEAGGKVLHYHGESDYTVPTASSVHYYESVRRIMYPDMSTNASYAALGDWYRLFLVPGAAHCGPDDSQPNGPWPQKTLETMIRWVEDGVFPETLNATVLQGEHEGEEQKLCAWPLRPLWTNNGTSMECVNDPEGMKTWVYDLNAFKMPVY

SEQ ID NO: 180 - protein, 588 aa, Aspergillus niger
  ref <308>: DATABASE ACCESSION NUMBER: UniProt A2Q818
  ref <309>: DATABASE ENTRY DATE: 2007-03-06
  ref <313>: RELEVANT RESIDUES IN SEQ ID NO: (1)..(588)
MYSLAAATLVGVASAASLNSVCTTDYVTSVLPTASDDIPSGITIDTSSVSASIYRNYSLTDSIFWEDLTINFCEVSFAYSHQNGDDRVVVQYWMPSPDLFQNRFLATGGSAYEINNGSGGGDIAGGVAFGAATGYTDGGFPYWGGTDFDDVVILGNGTANWPAIYNWGYQAIAEMTQIGKAFTNNFFNVGNNVTKLYTYYIGCSEGGREGMSQAQRAPELYDGIVAGAPAMRYGQQQVNHIAPPIQIQTIGYYPPSCVFDTVINATINACDGMDGKIDGVVARSDLCFQNFNVSSMLGKSYYCEAGSTTSLGLGYGKRSKRQTTSATPAQNGTINAKDIEVIQDLLTGLKDSNGDLVYFPFQPTAGFGDTTVYDSTTDSWTITSPNSNGEWITKFLNWQNVTDLDMWGVTNDDLKAWMIEGMTKYMDSLQTTLPDLTPFHSKGGRLLHYHGEADSSVPPTGSIHYHESVREIMYPDLSFAEGNEKLNDWYRFYLVPGAAHCATNDEQPNAGFPRDNFAHMIKWVEEDVVPVRINATVTSGEHKGEVQELCTWPSRPYWTDNNTMVCEQNATSIQAMLWKLSAYLTPVY

SEQ ID NO: 181 - protein, 477 aa, Aspergillus niger
  ref <308>: DATABASE ACCESSION NUMBER: UniProt A2QVJ4
  ref <309>: DATABASE ENTRY DATE: 2007-03-06
  ref <313>: RELEVANT RESIDUES IN SEQ ID NO: (1)..(477)
MSTTSDPPSSSPSTPTHIRIFTLNCWGLKYIAKHRHARLAEIGRQLAIASPPPEIVGLQECWTQQDYESIRQQTRHILPYGKFYFGGIWGAGLAILSKWPIEESSMFAYPLNGRPTAFFRGDWYVGKGVACARVRFGPGVQDVAEVFCTHLHAPYEREPNDSYICHRTAQAWEIAKLMRGAAERGHLVIGLGDFNMLPSSFAHQLIQAHSPVRDAWQVLHPDSSVGAAIDPVEQKRGKPIPSAEYNITENGATCDGKFNTWRWSKEDQKRLEKGQDIVVDKDAPCPKGKRLDYIFVGDGNYPPLYPAPRWSVESTRLSMTERHPTLRCSLSDHFAVEAVITRVPSEKVDNDTTISHQSPVPNTALTPDTYDRIIDMIHTYVRRERSQRRWRVAHFLASVIISIGCFIGVWWTGDHLPYVAFILVLVSTLSFGAGILDGLIGGLFMSSELRALKEFEWEVRNAKMIAEAVGGKGEKVE

SEQ ID NO: 182 - protein, 319 aa, Aspergillus niger
  ref <308>: DATABASE ACCESSION NUMBER: UniProt A2QC75
  ref <309>: DATABASE ENTRY DATE: 2007-03-06
  ref <313>: RELEVANT RESIDUES IN SEQ ID NO: (1)..(319)
MPFFRAKSSKRQIMFVKWHFLVLGAIPMIPAYPSGAAYKGGFEWDSTKYLFVLALIDGRIWRSEGGPNWVEYLTGCGLEEGLTSPFDCDQQLWDFAFAGSDISVEYTPLHHNFTVSLVNQVKQFNTYAQPVLKKTVDQSHALVAIWIGINDIGDSSKYDVDFPTFYNELMNTLFSSVQTIYSQGYRSYLFMNLPPLDRRPGNLGSADPSPNATQITWYNDALAQHASAFHDRYADTNVMLFDAHSELSYILDNPGDFGIVNITNFCAGYDQPDIAWNYQAYGCPTPLDTYFWYNSGHMTSHVHEILAGAVERKLEEWSD

SEQ ID NO: 183 - protein, 281 aa, Aspergillus niger
  ref <308>: DATABASE ACCESSION NUMBER: UniProt A2QSY5
  ref <309>: DATABASE ENTRY DATE: 2007-03-06
  ref <313>: RELEVANT RESIDUES IN SEQ ID NO: (1)..(281)
MKQFSAKYALILLATAGQALAASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPAEQGYAHGGVEYWSVDPYSAQNTFVCTGDEVQCCEAQGGQGVNDAHTTYFGMTSGACTW

SEQ ID NO: 184 - protein, 540 aa, Aspergillus niger
  ref <308>: DATABASE ACCESSION NUMBER: UniProt A2QHE9
  ref <309>: DATABASE ENTRY DATE: 2007-03-06
  ref <313>: RELEVANT RESIDUES IN SEQ ID NO: (1)..(540)
MVQGVAFGLLGLAASALGTYAPYYANLTWEQPRTLSNWSNLTVETRTGTFIGMLNDTYPDVRQFLRVPYAKPPIGDLRWLPPHRLDNSSRTYDSTFYGPACPQYVPAESDFWNEYEPENLLLNVGERLNQGSTAWSSSEDCLSLAVWTPSYANETSKLPVALFVTGGGGITGGINIPSQLPSAWVSRSQEHIVVTINYRVNIFGNPKSRALNDTSLTLMDVRAAVEWVYENIEAFGGNPENIMVRLQVSSHMTRANSKQLWGQSQGALLTHLYTLAWPEEPLAAKFGVISQGASATLNLSTTPDVYQDFDIVAKGLGCNYGDDAEAELECMRGISWVQIEEYINRYNSSPSIAFTNYIPDEKYIFSDERQRYLERKVARGPSIRSDTAREFPSTNTTSVNIEEGESDCLAVTDLALRASIGLETYRYYWAGNFSNISPVPWLGAFHWTDLLMIFGTYNLDVGEISQLEVDTSATMQDYLLAFLKDSSTVSETVGWPLYLGNETNGGLILEFGNGTAVRTITGDWLDAGCFNSSIPFRIWG

SEQ ID NO: 185 - protein, 317 aa, Aspergillus niger
  ref <308>: DATABASE ACCESSION NUMBER: UniProt A2QS56
  ref <309>: DATABASE ENTRY DATE: 2007-03-06
  ref <313>: RELEVANT RESIDUES IN SEQ ID NO: (1)..(317)
MWNGKKNKVPNLTGSIQQFRQTICEAKMRAQHQGESVIEGLDVYDLTTDFPSKLKLRIYKPLSPEANGAVMIYFHGGGWAMGDLEGEDSTCRTLCVQIGLNIVSVDYRLAPENPHPAAIQDSITALRWVYHTCLCRKGLGIANSTSVDRSSKTVLPMALTRVRFTLAGPVLGQTWYDIPMLSGTRTVLCLSEPHYQRMGLKSMDQFADTPILNQPLMKQFLEWYQPYDQTDPTVSPLLFRRLDASPPCFIMICGRDPLRDEALAYADKLEEKGYMRVAVYSGMPHAFWILPELTTTKTATQDLIDGVRWLMGSANWK

SEQ ID NO: 186 - protein, 343 aa, Aspergillus niger
  ref <308>: DATABASE ACCESSION NUMBER: UniProt A2QV39
  ref <309>: DATABASE ENTRY DATE: 2007-03-06
  ref <313>: RELEVANT RESIDUES IN SEQ ID NO: (1)..(343)
MAHNLSIAGVQLELSQATAGFEYYDSRFLNITGNAPKLEVLLENNDFPFAHEASVFIPSTDELFMTSNIFTDPLTNQSTIKISKVSLSTNPITSEIINTTIPLPNGGVNHDSGILFCGQGTLNQSGGLFQMSLDPPYESELLISGFYGREFNSLNDVVVHSDGSIWFTDPTYGYEQGIRPAPQLPNQVYRYDPTTGDVRVIADGFGRPNGIAFSPDEKVVYITDTAYTVGDGTTDPTKPSTIYAFDITTYHGQPFLTNRRVFAMAANGIPDGIKTDMEGNVYAGCGDGVNVWSPGGVLLGKIYIKSGVANFSFGRNGQMFIMNENKLLSAQLGHWVRGSLLKI

SEQ ID NO: 187 - protein, 560 aa, Aspergillus niger
  ref <308>: DATABASE ACCESSION NUMBER: UniProt A2R256
  ref <309>: DATABASE ENTRY DATE: 2007-03-06
  ref <313>: RELEVANT RESIDUES IN SEQ ID NO: (1)..(560)
MARVAAGMRSRDWPPIGPAGPRLDIPRPFQGSPSSSASLEVVPPSSATVVRSCNFVPCTVTMDVKSFQQARGTPPPEERRPLLGPDDEVVQYEVDDDIKGRSRQPASRWVPTWAKSIFITAILLIMSVLLVLALLFLGIGISGLPHGSSGKPSAPHAPIKNVVVLVQENLSFDTYAGGLTYNSTIDGLVNRKYCNPSDIEDHKSYQVCAKPTAKNVAPDDPDHSIAGGSMQVYSTYHPDNMSAASMQGFVTEQVRSYGIDRDLSRAAEVINYYTPDHVPVLNAMAENFVLFDAWFAAVPGPTNPNRAYLTSGTSYGHGLNDIGFLTSALPQVSIFEQLSNANISWINYSNTTGFLPDALFYKWTLRTGKSETHIKPIDEFYRDAKAGTLPQFTWINPECCKYMSFHPPSPVNMGEGFIKSIYEALRSSPQWNETLFILTFDEHGGFADHVPPPENVPPGDHRTHKEWALDGSKIEFKFDRLGIRVPTLLMSPWVGKGVVQNRPTNQPNDFTHTSILKYLSELWDLPVLTPRVTWSPSFGSLITTTYRDDTPDKLPEPADF

SEQ ID NO: 188 - protein, 663 aa, Sporotrichum thermophile
  ref <308>: DATABASE ACCESSION NUMBER: UniProt G2Q0K1
  ref <309>: DATABASE ENTRY DATE: 2011-11-16
  ref <313>: RELEVANT RESIDUES IN SEQ ID NO: (1)..(663)
MRLSDLLPLALLPHCTSAAAGEPVIKRTAVRNDDVTISARARPDAPDGYAPAVVPCPQDKPTIRSASSLSKSESDWLAKRRPLTVEPMIQLLKRANIEGFDAEAYINRVADDVKDLPNIGIAVSGGGYRALMNGAGFIAAADSRTPGSTDKGGIGGLLQASTYLSGLSGGGWLVSSIYANNFTTVTALRDGSEDSSVWKFDSSIFTGPDLPGILDTARYWAKVASQVASKKDAGFETSITDYWGRALSWQLIDAPDGGPSYTFSSIADDDDFSNARTPFPILVADERAPGQKIISLNATVFEFNPYEMGSWDPTTFGFAPIRYLASNFSAGVVPRDGNCVRGFDSISYIFGTSSSLFNAFLLQNITSVDGVPDFLVDAATAVLEGISAEENDIAQYVPNPFLGWNRQANPAAESDSLDLVDGGMDLQNIPLHPLIQPLRAVDVIFAVDSSADTTYSWPNGTAMRASYDRSHGDIANGTLFPPVPDDRTFIAHGLNNRPTFFGCDVDNFTLSSSSTAPPLIVYLPNAPYTAWSNVTTFTPSYSLAERNAIIRNGYNAATQGNGTLDEQWPVCVACAVLSRSLARTGTAVPDACRACFDRYCWNGTVADATANVASGAGGEEYQPTFKIDNGSDDDTSAGAKVALAGSPAWAALFVGLVAAVVML

SEQ ID NO: 189 - protein, 521 aa, Aspergillus niger
  ref <308>: DATABASE ACCESSION NUMBER: UniProt A2R0Z6
  ref <309>: DATABASE ENTRY DATE: 2007-03-06
  ref <313>: RELEVANT RESIDUES IN SEQ ID NO: (1)..(521)
MKVSSLLSVALPGAALAATDSFQSRCNEFQNKIDIANVTVRSVAYVAAGQNISQAEVASVCKASVQASVDLCRVTMNISTSDRSHLWAEAWLPRNYTGRFVSTGNGGLAGCVQETDLNFAANFGFATVGTNGGHDGDTAKYFLNNSEVLADFAYRSVHEGTVVGKQLTQLFYDEGYNYSYYLGCSTGGRQGYQQVQRFPDDYDGVIAGSAAMNFINLISWGAFLWKATGLADDPDFISADLWSVIHQEIVRQCDLVDGALDGIIEDPDFCAPVIERLICDGTTNGTSCITGAQAAKVNRALSDFYGPDGTVYYPRLNYGGEADSAYLYFTGSMYSRTEEWYKYVVYNDTNWNSSQWTLESAKLALEQNPFNIQAFDPNITAFRDRGGKLLSYHGTQDPIISSTDSKLYYRRVANALNAAPSELDEFYRFFQISGMGHCGDGTGASYIGQGYGTYTSKAPQVNLLRTMVDWVENGKAPEYMPGNKLNANGSIEYMRKHCRYPKHNVHTGPGNYTDPNSWTCV

SEQ ID NO: 190 - protein, 277 aa, Aspergillus niger
  ref <308>: DATABASE ACCESSION NUMBER: UniProt A2R1X8
  ref <309>: DATABASE ENTRY DATE: 2007-03-06
  ref <313>: RELEVANT RESIDUES IN SEQ ID NO: (1)..(277)
MRLSSLALASSAILPALGYSINDFSCNSTEHPNPVVLLHGLGATYYEDLNYLQGWLQTQGYCTYAKTYGAYEGFPFVGGLKAIAESATEIAAYIREVKEKTGADKIDLVGHSEGAFQTLYVPKFEDGISEMLDKLVAIAPPTRGTNLAGIYDIAYVLGNLSRDLIGDVLDTVGCAACDDLGPDGAAIDRLNDGEPIVQPGNNLTVIASRSDELVTPTTTSFVHEDGVTNEWVQDTCPLDPVGHIGEAYDLNVWNLVKNALDSTPKREFVCSLGSPGR

SEQ ID NO: 191 - protein, 355 aa, Aspergillus niger
  ref <308>: DATABASE ACCESSION NUMBER: UniProt A2QRK3
  ref <309>: DATABASE ENTRY DATE: 2007-03-06
  ref <313>: RELEVANT RESIDUES IN SEQ ID NO: (1)..(355)
MSSWKQPLTFWEKVQEAWNRLIVYKTLLSVSITAAFRGKDGAKQYKVHVLNAVTRKVCVTFTERQLQLQDTPTDEVYRQFMASRGLQPQTVPLNHGAKGHWIGNRNAKNVIVYYHGGGFFLFGRPHHYQLLAHILNRLNEAGHDDLAIFFLSYSLMPHAVYPVQLRQSVEALRYILTETGRSPANIFLGGDSAGGNLSLAVLLHLTHPHPEIEPLSISQPLAGVFGCAPWISYKMDGHSFRENAYKDALSKEILDRWSNQYLAGKEGDPWSEPARAPMDWWEGLKAEDFLMTAGRDEILLSPINEFVERFKKVVPNTVYVVAQDETHDSAVFAADIVGYDTQQTQAIINWLGARL

SEQ ID NO: 192 - protein, 508 aa, Aspergillus niger
  ref <308>: DATABASE ACCESSION NUMBER: UniProt A2QV40
  ref <309>: DATABASE ENTRY DATE: 2007-03-06
  ref <313>: RELEVANT RESIDUES IN SEQ ID NO: (1)..(508)
MSNFSICSPAAIQTPVVYGAEILSLSAAWVTNYTDYIPSSFNYNGGTVDLENAKFCNITVKYTHPGYEKNITVETWLPEPANWNGRLQATGGGGWAAGRFVLSEFFMGGAIGEGFATTTTDAGLGKDTTGPREWALISPGNVDWVAVENFGSRAFSDQAIIGKGLINSFYGRAPEYSYWSGCSQGGRQGMMIAERYPTAYDGIAASAPAQSFTKFTSSLYYPLLMRIWHNVNPLVCELDFLTSEAIKYCDHLDGVVDGLISNMTACDYNPYTAVNMTFTCDSLNHTIALSQGAALIAEAAWSGAHTTDGHQLWFGYNPGSDIGSTFGAQPETNISSLATTKDEWFNLFVAKNISFNTMGLSHEEYQEFFNLITSEYGSAWNADDANLQAFKKNGGKLLTHHGMADPSIPTKGTEYLYNKARALFPDVQDFWRFFESPGLGHCAGGLGGQPTTVMKALQRWVENGTAPDTLPVEYPSLGNGLHRNLCPYPSQIEYIGGDISLAESFRCT

SEQ ID NO: 193 - protein, 681 aa, Aspergillus niger
  ref <308>: DATABASE ACCESSION NUMBER: UniProt A2R5R4
  ref <309>: DATABASE ENTRY DATE: 2007-03-06
  ref <313>: RELEVANT RESIDUES IN SEQ ID NO: (1)..(681)
MAAMASLLLLALPAGAKASSAPTSLLFQNDGNWTAHGERPSALLVHTPAGRRQAETVCAEYEEQLLRCDDVHHFRQSFQYQQYLGTLTNDTLLWTACSTPVTLSGTSATDNVSSDGEWPFVCTNSAPLVDRVDTDYSSFPRVNVTAGNITFEGLRDHLTFRFAGIPFAQPPIGTRRFQYAEAWDATNVSYVNATQYSPACLQFGYFDGNSYDLNPWGNDENCLYLNVYTPFLPGDTDVPEDQLKPVLFWIHGGGFSQGTGSDLTFDGGSLTSRSDVVIVTSNYRLNIFGYLSLDDGTIPGNYWMSDNIAALRWVQQYIRGFGGNPNNVTIFGQSAGGANCIELVASPQAAGLFQGSIQQSAGNGRFSTQSAIAELAEPYLSPYCNETGAARLACLQRLPSSVLLNASADIFFTPVIDPVYLPDAPMALVAQGSSYINSVRMMSTLMPEECQSLTTTTLAPNMTDFQTALDLLIPGGWIDQEQADHIIPSGLWLISNETFHNGSTSYSSVYNASVKIATENNQECPNGAYAMVGAATVAFPSMHVAYHQRGYALSYYDFYDLCTFPVGKPDTPYYRCHSSDLYEVFGTYYIYDQPIRVPEDIYYTNAVQDMWGSFARTGDPNVAREYLIARGYNTTLEFFAGWRWPEFTASNMVLADLQYPRPGYTDVPDLEHCRYLASVQY

SEQ ID NO: 194 - protein, 648 aa, Trichoderma citrinoviride
  ref <308>: DATABASE ACCESSION NUMBER: UniProt A0A2T4B235
  ref <309>: DATABASE ENTRY DATE: 2018-07-18
  ref <313>: RELEVANT RESIDUES IN SEQ ID NO: (1)..(648)
MSRHLAALLAAAAVLAPAGASAVPPQDIRYRDLQEFPRSLEGRATDQSPKGYAPSAVDCPSDRPEIRVGSDLSPQEKEWLPRRRNNTIAPIRDFLKRVAIPGFNSDRYLSNVEKDATALPNIGLAVSGGGYRAMLNGAGAIAAWDSRSPGSNDTGKLGGLLQSATYLSGLSGGGWLVGSIYTNNFTTVQGALNSGTIWQTQNSILEGPEQYSLLSYYNEIFDDVDAKDDAGYDRSITDYWGRMLSYQLVNATNGGPGFTFSSIAEDPDFKNARTPLPFLVADGRAPGQIIISNNSTVFDINPWEMGSSDPTLNGYVPLKYAGSRFANGTLPKNESCMVGFDNVGYVMGTSSSLFNQIVLYLRDDNSNYVPKGVPDFVIKILTGILTVLGNENNDIADWTPNPFRGWNPKNNPGAGSERLTLVDGGEDLQNVPYHPHIFQARKVDVVFSVDSSADTDNGWPDGASITATYERAIEKISNGTGFPYVPGKNTFLNLGLNTKPVFFGCNSTNVTGESPLIVYLPNYPYQFQSNISTFQMTTELDERDAIVTNGWDVVTQGNATRDANWPVCVGCAMLARSFERTRTPVPDACNKCFQQYCWNGTLAEQTPGDYDPTFFSTPIEIESSGAKSAGGATVVTALAAVVCAVLLM

SEQ ID NO: 195 - protein, 270 aa, Aspergillus niger
  ref <308>: DATABASE ACCESSION NUMBER: UniProt A2QYU7
  ref <309>: DATABASE ENTRY DATE: 2007-03-06
  ref <313>: RELEVANT RESIDUES IN SEQ ID NO: (1)..(270)
MTRSIFIHTLLALSALTSVHGANSPGCGKNPTLANGVHQINGREYTLKIPDDYDANNPYHLIFGLHWRGGNMDNVVSGDSIQPWYGLESRAQGSAIFIAPNGLNAGWANTNGEDVAFIDAIMEQVESDLCVDQSSRFATGFSWGGGMSYSLACSRAKEFRAVSVLSGGVISGCDGGNDPIAYLGIHGINDPVLPFDGGVELAERFVGNNGCQPASIEKPQSGSNGWKRTDFYGCSKPVSFIAYDGGHDGAPLGVQSSLAPDATWEFFMAA

SEQ ID NO: 196 - protein, 297 aa, Aspergillus niger
  ref <308>: DATABASE ACCESSION NUMBER: UniProt A2R709
  ref <309>: DATABASE ENTRY DATE: 2007-03-06
  ref <313>: RELEVANT RESIDUES IN SEQ ID NO: (1)..(297)
MFSGRFGVLLTALAALSAAAPTPLDVRSVSTSTLDELQLFSQWSAAAYCSNNIDSDDSNVTCTADACPSVEEASTKMLLEFDLTNNFGGTAGFLAADNTNKRLVVAFRGSSTIKNWIADLDFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 197 - protein, 335 aa, Aspergillus niger
  ref <308>: DATABASE ACCESSION NUMBER: UniProt A2QG70
  ref <309>: DATABASE ENTRY DATE: 2007-03-06
  ref <313>: RELEVANT RESIDUES IN SEQ ID NO: (1)..(335)
MSHEALNPIHPSVLPHLDPTFIELYNKHVANTPSGPIDLTVLRSKYSVLYSYGTGPAPEPARVYDATIPGHNGDLIPCRVYEPDSPGPWPVHVDFHGGGWGLGDLDTESHICKHIAVKAKVAVVDVAYRLVPEHAFPIGIQDSFAALQHLASPAGRAQFPSLDTTRISLGGVSAGGNIALILAHLARDHQLPLRLVAVGTPVIDDISVYTTAHDSPFPSMQEMEHAPTLNWARLKWFDQLKWRSLSEDENVRQKQMAEVKWYANALKAPDFTRLPRTVIYTAGCDPLRDEGEAYARKLVEGGCEVTVRRFEGVPHPFMHMDKGIFFPLQFVWCLC

SEQ ID NO: 198 - protein, 543 aa, Aspergillus niger
  ref <308>: DATABASE ACCESSION NUMBER: UniProt A2R6H5
  ref <309>: DATABASE ENTRY DATE: 2007-03-06
  ref <313>: RELEVANT RESIDUES IN SEQ ID NO: (1)..(543)
MTSSLPPVVVNGGLIEGKTSDVDASITLYLGIPYAAPPTGPRRFQPPQPVLPWDGVKQCHQIGPICPQAPPDPRWINVLQGHPQSEDCLYLNVFQPGEAHEKPYPVFVWFHGGGFREGGSADPNFDGTALAKKGLIVVVPSFRLCNAESASGTSGMMGMLDAIEVLRWVQSNIAAFGGNPNQVTIGGQSAGNAMCHTLLVSPLARNLLHGVILQSGPRSLQEPAVANGPMSYRTLQQAEEDGVQLLRELGLQSIEELREFNDIDKLCELSTRRDHRCWGPPPLFRLTLDGHVIPKPWHQMLAECPSNDVPILAGMNSEEGGTYNEPRFTYDDFVECVESRFGPHSTYGQGDSKWVKRFHELYTPTDHETGKGPLDAWNRAARDNTRNNIALWAQEYHQKTASPVYGYYFTHPIPPWNNWQPDYSQPKVPGFTNQKGPVTGAYHGAEFAYTFNSLTTNNLRPWSNTDRIVGEKVSTLWANFVKHGNPNGPPGENKGPEGVACWPNLNDHPHTLLELGGEWQTIRTTDPENEQFWTSYVRSQKAW

SEQ ID NO: 199 - protein, 413 aa, Aspergillus niger
  ref <308>: DATABASE ACCESSION NUMBER: UniProt A2RBF9
  ref <309>: DATABASE ENTRY DATE: 2007-03-06
  ref <313>: RELEVANT RESIDUES IN SEQ ID NO: (1)..(413)
MIAFNVLFNPYSLILTYFSLLLPVRGFVRSETDRIPSGQDLRPIPEEIYNSLDELARVVDVAYCVGSTGLQKPFQCLSHCSDLKGFELITTWNTGPFLSDSCGYIAVSHSPSPNRIIVAFRGTYSITNTIVDLSAYPQAYVPYNTGHKNGKKEPSCYNCTVHAGFFTSWQNTRSTILDHVAAAREQYPDYKLVLVGHSLGGAVAALAGIEMQLRGWEPTVTTFGEPKVGNRAFAEFLGKIFRLDENSAWRFRRVTHVYDPVPLLPLEEWGYAMHAGEIFISKEDLPPSVDDVHFCEGPRDARCISGEGGEMALAVALHERASLAADAKSQAGWADAESTEQHNMPDGHISQTSLHVQEGAMKHRGLFDLPRRLIPSRYHLWELLFSHRDYFWRVGLCVPGRDRAGKGWWTSDS

SEQ ID NO: 200 - protein, 348 aa, Trichoderma reesei
  ref <308>: DATABASE ACCESSION NUMBER: UniProt G0RHJ4
  ref <309>: DATABASE ENTRY DATE: 2011-10-19
  ref <313>: RELEVANT RESIDUES IN SEQ ID NO: (1)..(348)
MRSILVIPSFVAVLNAFSLFPKPHDDFKYLITFGDSYTDNGRLGYYGSHQAHGPPPGVMPPEANVTASGGLQWPQYVEASTGATLYDYAIAGATCDNNNVERWAAFMNANYPSIITDEIPSFKADRKTKLYRGVTSANTVYALWIGTNDLSYTGILSDSQVKGTNITTYIDCLWNVFDAIHAAGGRRFVILNNNALQLTGLYRPLSDGGAGDNQFWQNKTLYNQTEYAQKMLEYTTSSNTMIDYGVPFHLLVKNRWPGSKVAVYDIHSLIMDIYNQPSRYLEPPHNVVGYYKHCDVNGTNCLYGPGRLDSYLWYDELHPSNITASYIAREFLNVVSGRSKYGTYWEHW

SEQ ID NO: 201 - protein, 303 aa, Aspergillus niger
  ref <308>: DATABASE ACCESSION NUMBER: UniProt A2QZI3
  ref <309>: DATABASE ENTRY DATE: 2007-03-06
  ref <313>: RELEVANT RESIDUES IN SEQ ID NO: (1)..(303)
MLSTHLLFLATTLLTSLFHPIAAHVAKRSGSLQQITDFGDNPTGVGMYIYVPNNLASNPGIVVAIHYCTGTGPGYYSNSFYATLSEQYGFIVIYPSSPYSGGCWDVSSQATLTHNGGGNSNSIANMVTWTISEYGADSKKVFVTGSSSGAMMTNVMAATYPELFAAGTVYSGVSAGCFYSDTNQVDGWNSTCAQGDVITTPEHWASIAEAMYPGYSGSRPKMQIYHGSVDTTLYPQNYYETCKQWAGVFGYDYSAPESTEANTPQTNYETTIWGDNLQGIFATGVGHTVPIHGDKDMEWFGFA

SEQ ID NO: 202 - protein, 592 aa, Aspergillus niger
  ref <308>: DATABASE ACCESSION NUMBER: UniProt A2QTI9
  ref <309>: DATABASE ENTRY DATE: 2007-03-06
  ref <313>: RELEVANT RESIDUES IN SEQ ID NO: (1)..(592)
MLNARSIALASLPVLLLLFAQQLASHPTEQIQAILAPWVPAALQDVVLYNRPRVIIPQGTVVGTTLTDTLKSPVDAFRGIPYALPPIGDRRFRRAEAVHATDEIIDASEFGPRCPGKQLLNPNDIGGDEDCLTVNVFRPHGAQGKLPVAVYVHGGAYNRGTAKYPASGHNTASMVGWSDEPFVAVSFNYRIGALGFLPSTLTAKEGILNLGLHDQILLLQWVQENIAHFNGDPTQVTLIGLSAGAHSIAHHIMNYNPPNTPLFHRAIIESGAATSRAVHPYNASLHESQFTDFLTETGCTNLPDTAILPCLRALPSSAITTASISVFDKYNPSIRWAFQPVIDHEIIHRRPIDAWRSGKWNRMPILTGFNSNEGTYYVPRNLSLSEDFTSFFRTLLPAYPESDIQTIDEIYPDPNVYATASPYLETRPIPSLGRQFKRLEAAYGHYAYACPVRQTAGFVANDDGCGEPVFLYRWALNKTVIGGANHGDQMEYETFNPAVRDISEAQREVAGLFHAYVTSFVVHGDPNVLGGRYEGREVWERYSGEGGEVMVFGEGNDERAGGDGVGVAARLKRDEWGVKECGFWSGRSGISE

SEQ ID NO: 203 - protein, 318 aa, Aspergillus niger
  ref <308>: DATABASE ACCESSION NUMBER: UniProt A2QZK9
  ref <309>: DATABASE ENTRY DATE: 2007-03-06
  ref <313>: RELEVANT RESIDUES IN SEQ ID NO: (1)..(318)
MPLAPEIQQFILGFKAQWDGSVNSACQDFFEARHASLESANPNPSIQCENNVKYGPDPRHRLDVFWPADAASTDATLPVVVYFHGGAFKLGDNTITPHMHANIGRFFASKGMVGVLGTYRLLPEARFPDGREDIASALSWLHSNVHQYGGSRNAIFALGQSAGGGHLAMSLYSGRLKTNEEQGLVRGVLLLSAALKYDLSKKGRRESMEQYYATTDHAIIHSRSAYGIFHSLPPVEDADVVAVPTPELFLMLAEWDFEECVRGNLDFVRLYAERRGHLPRFEVLPGHNHVSYALSIGLPGDEVGPKIADWVMRCSEGA

SEQ ID NO: 204 - protein, 575 aa, Aspergillus niger
  ref <308>: DATABASE ACCESSION NUMBER: UniProt A2QBC9
  ref <309>: DATABASE ENTRY DATE: 2007-03-06
  ref <313>: RELEVANT RESIDUES IN SEQ ID NO: (1)..(575)
MRRAAMMAGLTATTAQAASLADVCTTANVKAALPSSVYGLTMIPSSVTASPVYNASTSGQVFFPDATYDYCGVTFNYTHNGRGDTVKLQYWLPAPESFENRFLATGGMAYMISGGSSYLPGGVMYGAVAGTTDGGFGGELDTAFLLANGTINYEALYSMGYHGIGELTIVGKEFTKNFYSMGDEKLYTYYQGCSEGGREGWSQVQKYPGVYDGVIPGAPAIRYGQQQANHLYSNVVEKTLGYYPPPCELEKIVNATIDACDSLDGLVDGVVARTDLCQLHFNINSTIGLPYHCAASSSSSIGLGFGKRGTDPAINGTVSAEGAAVAAEILKGLHDSKGRRAYISYQPTASFSDAETSYNSETGEYELSIASTGGEWVAKFLELRDADNLSTLDNVTYDTLRDWMELGWKRYEDVMQTTWPDLTEFEKAGGKIITFHGESDQSIPTGSSVHFYNSVRSIMYPDMSYNASVAAMGDWYRLFLVPGASHCATNDVQANGPFPQTNLAVMINWVEKGVVPHTLNATHLAGEWEGQNAQLCSWPLRPLWTENGTKFNCVYDQASLDTWDYTFDAYKVPLY

SEQ ID NO: 205 - protein, 299 aa, Aspergillus niger
  ref <308>: DATABASE ACCESSION NUMBER: UniProt A2QXD2
  ref <309>: DATABASE ENTRY DATE: 2007-03-06
  ref <313>: RELEVANT RESIDUES IN SEQ ID NO: (1)..(299)
MARDVQARLTYLQWQPSYTHTRPYRIGVFSGRRKRNADRDKTTNLVFHVADHPETIRDIRGLIDAPPFDLDINGFAYKRCPPPAITKPYEYSDPQKINDIFLPECEAILKEHVNGADEVKIFDWKIRKKKSAKEKRTRNPNLQGFARQVHIDTLLTRDEIGTPTMERIRNHLPEESQHLLSGRVQLIILWRPISGPIEDHPMAVCDGQTMDATKLIETDMIRGNYTGTMLYPQYEANSARRWYYMSEQETQDVLLFKGFDTKEDSVKYTPHTSFSPLNTPESSCSRISVEVRALVFSHE

SEQ ID NO: 206 - protein, 321 aa, Aspergillus niger
  ref <308>: DATABASE ACCESSION NUMBER: UniProt A2QEH4
  ref <309>: DATABASE ENTRY DATE: 2007-03-06
  ref <313>: RELEVANT RESIDUES IN SEQ ID NO: (1)..(321)
MLSQALATHERRSNTPFLLSKESFDTHVHVFDPKLGPYAAGRAYTPEDAPLQKLLALNQSLTRSYNNTTLVLVQPSPYKTDCSVMMHCLRELKDRGISSFGIAVLDLNSTTNAQLSELHALGVRGVRLNFQADGKEVDITHLVAILNHTADRIHHLPGWAIQLFVPGWTWDLLYDAVRELPVRVIADHLGGMRGASKLPSDLQSTPTSQPGFRSLLSLAKQSIVYVKVSGLYRMSNCLASTFDDLQPIVQVMASEISNQIIWGSDWPHTGDGHERVKHSIENKEPFRTIDNHAILQRLYDWMGDDAYWKMMVDNPGRLYMD

SEQ ID NO: 207 - protein, 236 aa, Aspergillus niger
  ref <308>: DATABASE ACCESSION NUMBER: UniProt A2QT66
  ref <309>: DATABASE ENTRY DATE: 2007-03-06
  ref <313>: RELEVANT RESIDUES IN SEQ ID NO: (1)..(236)
MLSRIVTTLTFNALLGFSRATLLNSTDCADIHFMLARGTTEDYPGTTYTMAELVAENTTLSTNYENIIYPAVSETESDSYFIGRAAVGSQVNRYAADCPNSRIVLISYSQGAMIVGDALAGGGGDSTLGNATQPLVSEDVSKHIAANVYYGNPRHAPYQPYNMGNNTWNVTGKYPRLDYQINYLHDRYRHVTADWCNDGDGVCSPSEGADALSLHMAYANDYDPIAAAWILEKLRA

SEQ ID NO: 208 - protein, 529 aa, Aspergillus niger
  ref <308>: DATABASE ACCESSION NUMBER: UniProt A2QL90
  ref <309>: DATABASE ENTRY DATE: 2007-03-06
  ref <313>: RELEVANT RESIDUES IN SEQ ID NO: (1)..(529)
MVALLTSFAWAGLTALALGELYPPYYADLSWQPARTLSNWSNLTVETRTGTFVGMLNDTYPNVRQFLRVPYAQPPVGDLRWLPPQKLVNSSKRIDSTRYGPACPQYVASGSSMWAEYAPPSLLLNIGEAPNQGSTAWSSSEDCLSLAVWTPAFANKTSNLPVALFVTGGGGVTGGIDIPSQLPSNWVSNSQEHIVVTINYRVNIFGNPKSKALNETSLTLLDVRAAVEWVAENIRAFGGDPDNIMLWGQSQGAALTHLYTLAFPDDPRVAKFGVISQPPSVTINLTETTDVYEDFHIVAKGLGCNYGDNAEAELECMRQVSWVQIEEYINRYNGTRSIAFSNYIPDEKYIFSDEAARYAAGRVARGPAIRSDASREQASTSVATTMEGEGEWVCTAYQDSILRSSLGLDTYRYEWAGNFSNISPVPYLGAFHWSDLLMIFGTYMTDAGNISALEVATSRTMQNFILAFIKDPSTVSSTVGWPAFNASAPSGGLILEFGNGTSVRNITGDFLEAGCWDSAVPFRIYEPRK

SEQ ID NO: 209 - protein, 581 aa, Aspergillus niger
  ref <308>: DATABASE ACCESSION NUMBER: UniProt A2QV44
  ref <309>: DATABASE ENTRY DATE: 2007-03-06
  ref <313>: RELEVANT RESIDUES IN SEQ ID NO: (1)..(581)
MRKSTRAVVAALAAATAQATSLSDLCTVSNVQSALPSNGTLLGIDLIPSAVTANTVTDASSGMGSSGSYDYCNVTVTYTHTGKGDKVVVKYALPAPSDFKNRFYVAGGGGFSLSSDATGGLEYGAASGATDAGYDAFSYSYDEVVLYGNGSINWDATYMFSYQALGEMTKIAKPLTRGFYGLSSDKKIYTYYEGCSDGGREGMSQVQRWGDEYDGVIAGAPAFRFAQQQVHHVFPATIEHTMDYYPPPCELDKIVNATIEACDPLDGRTDGVVSRTDLCMLNFNLTSIIGESYYCAEQNYTSLGFGFSKRAEGSTTSYQPAQNGSVTAEGVTLAQAIYDGLHDSNGKRAYLSWQIAAELSDGDTEYDSTTDSWTLSIPSTGGEYVTKFVQLLNIDNLENLDNVTYDTLVDWMNIGMIRYIDSLQTTVVDLTTFQESGGKMIHYHGESDPSIPTASSVHYWQGVRQAMYPNTSYTQSLKEMSDWYQLYLVPGAAHCGTNDLQPGPYPEDNMEIMIDWVENGNKPSRLNATVSSGTYAGETQMLCQWPSRPLWTSNSSFSCVHDSKSLATWDYTFDAFKMPVF

SEQ ID NO: 210 - protein, 532 aa, Aspergillus niger
  ref <308>: DATABASE ACCESSION NUMBER: UniProt A2QV27
  ref <309>: DATABASE ENTRY DATE: 2007-03-06
  ref <313>: RELEVANT RESIDUES IN SEQ ID NO: (1)..(532)
MDQSRRARLALATLIPLLTGANAALYDTVIDTQYGGVQGYPAFTSEPAGNLTHWKDITVWKNIPFAATTGGQNRWKAPQPVSAWNGTRDAKSFGNVCPSATQGSSEYTIDEDCLNLNIWSPANSTDAKLPVVMWSYPALSTAADALFDGGGMADQGIVFVNYNYRTGSFGWMAHPELSEEFYKVTGSNSSGNWGMLDQFAALKWIHENIAAFGGDPEHITVMGQSAGSAATQHILNSPLTKGLIVGAIIESGVRDPHDPLCTSLAEGYSTLEDQLAQGERFMASLNCSSIAEMRELPMEDLVVSGGTFGSTSEWSFGATLDYYAMPDTYYNTLIKGLAQDVPVITGNTKDESGASYGLNLTVSEYLADMNETFSEPWLSRFLELYPGNTTRTAPGAYNSQWTDRSKVGTWLWAQLWATARTSPVYTYFWDHAPPGQDQGAYHESEINYVLNNLYGTDLPWTAADYSIARKMNGYWANFIKTGNPNGGSLTQWPATGENAKVQHVGDGWGEIPTASDAKVKLFEEWFDTLKTY

SEQ ID NO: 211 - protein, 367 aa, Aspergillus niger
  ref <308>: DATABASE ACCESSION NUMBER: UniProt A2R098
  ref <309>: DATABASE ENTRY DATE: 2007-03-06
  ref <313>: RELEVANT RESIDUES IN SEQ ID NO: (1)..(367)
MSALKDEKTLSELRPRVLIQPLHNSIPSELLPRFDPVYVEHYNKYNAGRLHTHEVPIEDFRKNPAKYAIAYGRAQGPDVFRITEQKCPVQGGEITIRIFEPAPKADEHGKAKKRAAFVNFHGGGWVFGDLSVDHDFCKTLVDGLDGHLVAFDVDYRLAPEHKYPIPVDDCWTAFNWIRSQKAEEFNVDPNRIAVGGCSAGGHLSAVVAHLCRNGGIPLRLQVLNVPVCDLHSGYTPDGEFDRENCPYESYREMEFTAALPVARMAYFHRHFLGVPRPARSEEDWKISPIFAPDFSGLAPALVFTAEMDPLRDEGEAYAAKLKAGGCRVEMMRMAGAPHTFAMLDGILESGRIYTEKVIEAMKRELTG

SEQ ID NO: 212 - protein, 315 aa, Aspergillus niger
  ref <308>: DATABASE ACCESSION NUMBER: UniProt A2R845
  ref <309>: DATABASE ENTRY DATE: 2007-03-06
  ref <313>: RELEVANT RESIDUES IN SEQ ID NO: (1)..(315)
MTVEHQPRPEPVLFPNGGWDVHHHIFEPAKFAYAPDRHLTPPPATVQQFLAFKEKIGITNSVLTHGLSYGPDCTSLKAFVQELGESGTRGIGVIDPDKTTPEELQEMHKQGIRGIRVNLYQYQAMHDVERQKQALRDHIRAIKPHCPGWSIAFTHVHPEYWGELKPIIEEEVMSSSLHLVTDHFALLKAASMLPAEYEGDITRQPGFTEIMDLVRSGLLYVKLSAPYRVSHEAPRYADVKPLVRAFVDANPRQILWGSDWPHTPHMKVRTREEALRETPYLVIDDAEWLKSLRSWVTAEEWQAIMVSNPTRLYDW

SEQ ID NO: 213 - protein, 829 aa, Aspergillus niger
  ref <308>: DATABASE ACCESSION NUMBER: UniProt A2QYF0
  ref <309>: DATABASE ENTRY DATE: 2007-03-06
  ref <313>: RELEVANT RESIDUES IN SEQ ID NO: (1)..(829)
MQLQFIVGSLLLFGSASAAPAPPADARSHPSIDSLGTLQALKYNNLGPGNNGTAAVLVYDRLPYLSAESRCASIGEALYPLQDVSQANATEIGYQLDYLVYAKDVAANSSFWIAKGSPNGCQAYSHSRKQVIPAPCDRQLPALCTSSVPPTTDKDREAVNKSKISISFDDYRMTGYRDGRSFRFLGIPFADPPVRDLRFAPPRPYSGPKKIDATKMADSCIQSVSGFGTLDNGGISEDCLYLNVYSPVLPSSHDRNSTRKPVAVYFYGGAFTSGTASMVDYDGGNFASRNDVVVVTVNYRVGALGWLTTGNLTTGNYGTRDQILALKWVNKYIEAFGGDPNHVTIFGQSAGGQSVIALLSSTAAHGLFSGAIVQSAPVDLPWFAREVYTKIVTPNVAGAVGCNGTTSETALISCLRSVPATRYLDNTTEFEAAMTASTETIASDWLHSSEILASIEPLMPIVDDIGSGVIDDQFYRLLASDRLPNRVPTMFTTVTTEAALYVDQYVPNLGASEAALELVYSYAYPTSLIKSLIATDAFPLNASDSDSVRNTVADALTHSEWSCPQAYLLRHGGRHAFPRLWEVEVRHGHVQTTVDVPSICSPNTDFNATCHSADVLPAWGTLNSKTKNVSPYYNKRDILHSRLLNDIFGSFFRTRNPNPDLEMLKLRGPAYASTYQIFGPRGYYMPEYEIAERNRYFLTHGSGSQLVIFQLHFPFPSLLPTCTSPSYTPKCERHAQPHIFICLPAEGLTSAFSLVSKNNHDQVIPAGEMCRCRITLYVGGQGMDITYEILVLDLLPVALVLDQLSQYHMWVVILRPPFGRGKQFGLSDI

SEQ ID NO: 214 - protein, 623 aa, Aspergillus niger
  ref <308>: DATABASE ACCESSION NUMBER: UniProt A5ABZ1
  ref <309>: DATABASE ENTRY DATE: 2007-06-12
  ref <313>: RELEVANT RESIDUES IN SEQ ID NO: (1)..(623)
MFISDVDPDEGLSTSVARGAESRVSDKAPYFDTTVEVGSIEQHPAPDAGLKAPLQTGYELQDLGPVCDEESENASAVTERLLGEEGPFPGKNQLGTSIANNITHPLFPPLPSYGPPSLITSVQHLIIRCVSFVLSLVFLGTVILGALIQTASASVLQIRRTIGGQAPHTTRIYHEEERSRQVERTKASRRWSYRREKEVDEEALDECPPLEGGKDPLVCDVAYYARRVGLDVETFKVQTEDGFILTLWHARRPRGPHVFSGQTNPEASRRAPGKYPVLLMHGLLQSAGAFCANDDDSLAFFLCKSGYDVWLGNNRCGMVPEHTTLFQSDPRMWAWNIQQMGVLDLPALVSRVLFETGFEKLGLVGHSQGTAETFIALAKDQRPELGERISVFCALAPAVYAGPLVERVYFRFMRIIPPLVFRAFFGIHAFIPFMMTVHRRLHPRIYGTLGYYVFSFLFGWSDARWDRGLRDRMFQFAPVYVSAETMRWWLGGECFAHQKCILATSKVTQAEAAEDQRVARGHGEVRSNTAWYGPQMPPVALWIAGSDGLVDGRRLLHRLENGREPHVQLVHAKVIEEYEHLDVLWAMDAIDQVGQEVRQVLWETMPQEARTRCRMPRGVWTAR

SEQ ID NO: 215 - protein, 313 aa, Aspergillus niger
  ref <308>: DATABASE ACCESSION NUMBER: UniProt A2QZB2
  ref <309>: DATABASE ENTRY DATE: 2007-03-06
  ref <313>: RELEVANT RESIDUES IN SEQ ID NO: (1)..(313)
MELLAILGLLWAISKASSWTALQAPVRGPRGGTAATKHIMAMAVRTFFETVSIDQFRYAYSPDTSARLLETWARCTHTTLKKVKLPDGTTAFWLGNPDAERLLLHLPGGAYCLPALPSHIDYSTSILKGLGQAGIDAGMLFLPYELTPTAQYPHQMKQAVALLQYVIEDLGKRPSDIVLLGDSAGAHLILSVLSHLAHPHPHIPPLLLPENLAGALLLSPWMGESRTDYDSCRRNASRDLVSLKLLIHWADMFLGDTEPDSYNQPAGAPGGWWRDLPVEEIFIGVGGHEILYDSIIKTARKIKCYGLWDNASD

SEQ ID NO: 216 - protein, 580 aa, Aspergillus niger
  ref <308>: DATABASE ACCESSION NUMBER: UniProt A2QT57
  ref <309>: DATABASE ENTRY DATE: 2007-03-06
  ref <313>: RELEVANT RESIDUES IN SEQ ID NO: (1)..(580)
MRQYSRAAAATVALAASARAANSSSLASLCTVSHVQSALPANGTLLGIDLIPSSVTAKTTTERGSETEYCAVSVSYVHTGTTDEIVLNYGFPSPADFKNRFYVAGGFGYSLSTSSTGGLEYGAVGGATDAGYGALNGTTVDEVNLSGNGTINWDPIFMFAYQALGEMTTVGKPLTRAFYGLADDAKVYTYYEGCSDGGRQGMSQIQRYGDEYDGAIIGAPAFRYGQQQVNHLFSSVVEQTLDYYPPTCELEKIVNATIAACDPLDGRTDGVISRTDLCQLDFNLTSIIGEPYHCAAEVSTSLGFNFNKRNDGTSTSYTPAQNGNVTAEGVAVAQTIYDGLFNTAGERAYLSYRIGSEFSDGETAYDNSTGTWGVDIPSTGGEFVTRFVELVELSNLETLNNVTYDTLVDWMNTAMVRYMDTLQTTLPDLTTFKSTGGKVIHYHGENDPSVPTASSVHYWQSVMSIMYPNLGSSKAIEQMKEWYQLYLVPGAAHCGRNTLQPNGPFPEDNMATMIKWVEQDVQPTGLNATVDAGKYDGEVQSLCQFPKRPVWKSNKWECESDDEGADTFYYTFPAFKVPIY

SEQ ID NO: 217 - protein, 518 aa, Aspergillus niger
  ref <308>: DATABASE ACCESSION NUMBER: UniProt A2QL89
  ref <309>: DATABASE ENTRY DATE: 2007-03-06
  ref <313>: RELEVANT RESIDUES IN SEQ ID NO: (1)..(518)
MGILSLLAPASATLYDQTIQLPQGKVQGAAAFNESSAPSYIVNWKDISVWKGIPYAATTGGENRWKPPQSAPSWNGTLKATAFGASCPSSFAGDGVSEDCLSINIWSPATSTDAKLPVMLWSYAAGGESSQSTYDGAGMAAKDVIFVSYNYRTGPLGWLTLHELAEESGATGNYGLLDQIEALKWVYHNIAAFGGDPESITVAGQSFGSGAVYHMVNSPRTKGMIKGAIAESGLKDPYDPDLWGYGSDYRNMTWAYAFSKTYAESLNATSVADLRSMDLETVLSGTGASDFVGFDPVLNYHSMPNKYIVSLDEGAPNDVPILVGNNKDENGIDLSTTYTVAEYRSEINSTYGPYAAELLALHPAENTTQATAAYNSILRAGYCTSTWSWAQRWNQSSTEPVYYYLWTYSPPGSDGATHGSEVSYALNNLYAQTTTSYTDADYEVANIMSSYWANFVKTQNPNKGGSYNNGTLPYWGPNVPSQQTMFELGSLWKDIPFASAKEIQLYLEYFKYATPSPY

SEQ ID NO: 218 - protein, 305 aa, Aspergillus niger
  ref <308>: DATABASE ACCESSION NUMBER: UniProt A2QAC4
  ref <309>: DATABASE ENTRY DATE: 2007-03-06
  ref <313>: RELEVANT RESIDUES IN SEQ ID NO: (1)..(305)
MFLKSSCGNAAAQLSCEFVTPYRIPRGTWDTHMHVVEPERFPVSANAVYQPPEHTVDDAMNFESTLGIEKIVLVQPSIYGTDNSCLLEALKTLGPSRGRGVVVIDPTNIDTKTLEEWHLLGVRGVRVNLKSVGKVLSEHELTETLLQHAQIVRPFGWTIQVYVSLDMVPLLERVVPQLGVKLCIDHFGGPDLTAVQHDGESFNPYMLPGFSSLISLLRGGETYVKISAPYRLSKDEEYRDLEAMAQEFLEAAPDRVIYATDWPHTRFSGVNIEPFTETCLRICAKESGLAERVFRDNAEEMLRGV

SEQ ID NO: 219 - protein, 583 aa, Aspergillus niger
  ref <308>: DATABASE ACCESSION NUMBER: UniProt A2QX92
  ref <309>: DATABASE ENTRY DATE: 2007-03-06
  ref <313>: RELEVANT RESIDUES IN SEQ ID NO: (1)..(583)
MHFSHSSLLLGAICAWGLASPLPSSTSPTVHLPDSNVWFKETAGNLTESFLNIRFGEDTSGSNRFAPPKPYNYPSGSVVNATQSGAACPQQKDPIPDFPIFDNVTSISEDCLTLRVDRPLNTSSSDRLPVLVWIYGGGDTIGQIYDSAYDPSLLVYGAAQKDVPVIYVAMNYRLGIFGFASSPALNDSDSLNAGLLDQRLALWWIQDNIAAFGGDPDQVTIFGESDGATSVGLHITAYGGKESKVPFYRAIMESGGATADSGTASNKSGEHTATLTSLVNCTASSSQEELECLRRLPMKTLLNTAYAYELTLNSMGGMGVFIPAAPSPFIPDAPSKLLRTGQFSRNIDLISGWCETDGSFFTTTTLNSSSDIAAFLQDSYPNLSNASIAKALDLYPVSEFSPDPSGNISAQYFRASQMHRDLDFTCPSLLTVQTNVKYATDKSKVTNYLYALNQTAFAEVFEYLGMTYYGVPHFSDIMYLFNSVTNGLFKDVSTASDRKLASEMGASWASFAYYGNPSRARGSVKGWEQAYAANASSTTPELQVLGGPKMRFTGSGKGAAYDEDLVKRCAFWNDPVVASELGV

SEQ ID NO: 220 - protein, 334 aa, Aspergillus niger
  ref <308>: DATABASE ACCESSION NUMBER: UniProt A2QKZ8
  ref <309>: DATABASE ENTRY DATE: 2007-03-06
  ref <313>: RELEVANT RESIDUES IN SEQ ID NO: (1)..(334)
MTDSEITGFQSHHKDFTTITGQTPSLELLAEHRDYPFAHEAGIYIPETNNLWITSNRCVDPNGSKTQQRVYITRVDLNTSPITYEEIPTDIPMGNGGINYDKDSILICGQGSMTQPSGLYRMSITAPYTTELLKGDFYGRPFNSVNDVVVHTDGSIWFTDPIYGYRHEYRPEPCLPCQVYQWCPREGTIRAMADGFGMPNGICFSPNEKTVYITDTDRLHGDGTVFDHRASSIYAFDVSTIHGQPFLTNRRLFAMADHGIPDGIKCDLNGNVYSGCGDGIHVWSPGGVLLGRILIDGGVANFCFGRNGEIFALNEHRLWRVQLGAGVKGALLGL

SEQ ID NO: 221 - protein, 583 aa, Aspergillus niger
  ref <308>: DATABASE ACCESSION NUMBER: UniProt A2QBK3
  ref <309>: DATABASE ENTRY DATE: 2007-03-06
  ref <313>: RELEVANT RESIDUES IN SEQ ID NO: (1)..(583)
MRTALGVLAGATTIALSKAASLADVCTTSHAKSSLPSSDEIEGLEIDTSSITAGAVYNASTSGSYFFPAASYSYCNVTLSYTRPGLDTPFLLELWLPAPEDYQNRWLSTGGGGFAINSGSSSLPGGVMYGAAAGITDGGFGGFDTQFDAVFLEANGTINYEALYSFGYLAHHELTVVGKAFSRNFYSVGDSKIYAYYQGCSEGGREGWSQVQRYADQWDGAVIGAPAFRYGQQQVNHLYPDVVEHTLGYYPPTCELEKIVNLTIAACDALDGRVDGVVARTDLCKLHFNVNSTVGAPYSCPASTSTTVLKKRTSMSNTTPAQNGTVSAIGAAAASKMLDGLRTLDGRRAYIWYQPSSTFDDAQTQYNYDTGKWELDITSLGGEWVARFLELRDADNLSSLDNVTYDTLKEWMELGWQRYEDSLQTTWPDLTPFQSAGGKIIHVHGESDPSIPTGSSVHYHESVRQIMYPGMSFNESSEALNEWNRLYLIPGAAHCASSTTQPNGPFPQTTLETLIQWVEGGVFPTRLNATVLAGEREGEQQQLCAWPLRPLWKNNGTVMDCVFDEASYKTWVYDFDAYKLPLY

SEQ ID NO: 222 - protein, 299 aa, Aspergillus niger
  ref <308>: DATABASE ACCESSION NUMBER: UniProt A2QBH8
  ref <309>: DATABASE ENTRY DATE: 2007-03-06
  ref <313>: RELEVANT RESIDUES IN SEQ ID NO: (1)..(299)
MASFTAWLFRMFVTYIRRSRLVFGSAENMRNNMRELYLRPRNFNPPKNLEPGITIDRIDYGAWPLYRVSSAGNSVKKRPAMMYIHGGAFYREINPQHWKLVAQAVRDTGLDAIVPIYPLLPRPGTTAAEVIDGFMDICSRLEQPIVSIVGDSAGGMYTLATMQQLLKQHPELARRNDPWLGLDGLRQLLPLLGPGLPAHDPIVSPLFGDIETLPPVMLLSGTYDMLVADAQRLSAKFQGKGTEICMPGSFKNDKFTFIEQPEMVHVYPLLPHPEGAEARETIIHFLKQHTGKASVDNYH

SEQ ID NO: 223 - protein, 598 aa, Aspergillus niger
  ref <308>: DATABASE ACCESSION NUMBER: UniProt A2R8M8
  ref <309>: DATABASE ENTRY DATE: 2007-03-06
  ref <313>: RELEVANT RESIDUES IN SEQ ID NO: (1)..(598)
MTTTEEKIRATFPDLEWFPLTPPAEHPAYNYQGFHPGKRTVLSAGHVRSPGHRAFHTDVLFEQDIAITLRDGIKIYTDIFRPVDSDTSPVPAIIPWSPYGKTGTGPQSYDSMAPFRAGLEKSRTSGYEKFEAPDPAEWVPRGYAIINIDARGAGNSEGNITFWGQQEAEDIYDTIDWLSKQPWCNGSVGMAGNSWLSIAQVNFASRLEHPALKALAPWEGFTDLYRDLTMRGGMKHNEAFHKLILTGFAGHGTAENMPAMLSKRPFDDAYWQSKRIHTERIGDIPLYILASYSSMLHTRGSFETFRTAQSTRKWLRVHPYQEWYDLYRPEMVDDLSRFFDRYLKNTPNDWESTPPVRLSLLGFEGSSVPTILERPEHTYPLTRQELKKFYLNASTKTLQPSLPSTVTSTTHSALHGTSDFTLHFPTPTQLAGYPRVHLWLSTPHHTDMDIIVQIRKISATGTLLEHLNYPCPVPVDAVPNVNTAKTLGPQGFLRASHAVTRDETLSTEHEIVYRHDQAESIPAGKIVPIDITLWPMGMVFGAGEGIMLRVAGRDLCYPEVEFGPVEGEGSGGDVGEKEQVHEVHCGVEFDSYLVLPFV

SEQ ID NO: 224 - protein, 257 aa, Aspergillus niger
  ref <308>: DATABASE ACCESSION NUMBER: UniProt A2R618
  ref <309>: DATABASE ENTRY DATE: 2007-03-06
  ref <313>: RELEVANT RESIDUES IN SEQ ID NO: (1)..(240)
MLGSTPLGDSHIHIIESDKYPLNPDREYTPKAATREQAAAFERSIGIQHAVIVLPSVYGTNNSVLVDALRSSNGTYRGVCVLDLSAEIDNTTLQTFHDAGVRGIRINYGNEGTDAQITADTIRAASIARIHNWTLELWVPIAAFKSLHPIIPTLGVRVVADHYAHAMTGSRTGNPINSIDPFSILGFREVVDLMQRHHLFVKISAPYQNSRNEPLYSDLRVVAETLMLHGPDMVVFGSDWPHTASKEGNEAGGRLVE

SEQ ID NO: 225 - protein, 364 aa, Aspergillus niger
  ref <308>: DATABASE ACCESSION NUMBER: UniProt A2QK84
  ref <309>: DATABASE ENTRY DATE: 2007-03-06
  ref <313>: RELEVANT RESIDUES IN SEQ ID NO: (1)..(364)
MKPSWSLASLLGGAAIASADVYPPYYANLTWQAPRTLSNWSNLTVETQTGTFIGMLNDTYPNVRQFLRIPYAKPPVGDLRWMPPQKPEKSRRRYDSTRYGPACPQYVTGESTMWNEYSPPNLLVNLGENLNQGAVAWSTSEDCLSLAVWTPSYANRTSKLPVALFVTGGGGVTGGIEIPSQLPSPWVSRSQEHIVVTINYRANIFGNPKSRALNDTSLTLLDVRAAAEWVHENIEAFGGDRDNIMLWGQSQGAALTHLYTLAFPDDPLAVKFGVISQPPSVTIDLSTTDDVYQDFDIVAKALGCNYGDDAEAELECMRQVSWVQIEEYINRYSGSPSIAFSNYIRRKHTLLAYFFAQSDNPFSR

SEQ ID NO: 226 - protein, 429 aa, Aspergillus niger
  ref <308>: DATABASE ACCESSION NUMBER: UniProt A2R8C2
  ref <309>: DATABASE ENTRY DATE: 2007-03-06
  ref <313>: RELEVANT RESIDUES IN SEQ ID NO: (1)..(429)
MKSPTILSCALPVLLAALIGGSYAQTASIPASYQYLLPPLFHGNLSEDFVSGTESAQLSLNSALKEAQRAAFISYDKEFDEVIGQEPSAQIVSRGTYGYAYEAGIWVHDLNQVGATGEILGGRSVANLPQMWFTSAISSGPTYLSVLDLKTNEVTQPNLVKPHGSESFVLSNPNGGFYYDGYVYITMLGDATHVAGLVKINPRTLETSTVLNSYYGLGLPSVDDVSIMRDKETKQTHIFFSTLDLVPFGPPISAHASNVTIQLPNAFWSFTPDTETLRPVIPRSDVLGPNGVSIDGKNSYLYVTDTPDHIHPTGTGFPAIFRYTLSSENGFIPSNKQLFGFPRHGVADGLKVDAMGRVWTGEAEGVVVRNMAGKVIGIFNKEVFMGRQTPMTEMANFALAGDKLILLALDAIIVVQLAESIGVAHDLVL

SEQ ID NO: 227 - protein, 689 aa, Aspergillus niger
  ref <308>: DATABASE ACCESSION NUMBER: UniProt A2R0P4
  ref <309>: DATABASE ENTRY DATE: 2007-03-06
  ref <313>: RELEVANT RESIDUES IN SEQ ID NO: (1)..(689)
MHAFLLSLLVAPVLAAVGPESLGSDIFLLLHNDLLEGDSPLTNSSVIILDNKPLKEATEACNALGESLWGAASSTPADIKADLKYLSYQGNYKSNQCFWIAPVNATGRTIDLEGTISTADSNHQYPVLCTQSAPYSTKEYQNTSSQYQITVQANNEYLTGYRDHVIFRFIGVRFATEQERWTYPEPYIGNGSNVSALKYGSVCQRDANGNEENCLILNIWTPYLPRQPAEKKKLRPVAFWIHGGAFTGGSPDDPYYDGGNLASRGDVVVVGISYRLGTLGFLALNDGKTNGNFGLADQIAALDWVRQNIKAFGGDPDQIIIFGQSAGAASVRALLASPKAKGKFSRAIMQSNLGGLAYGTTYSRYYTIDEEMDVAGNAILEETNCTNATSPVDCLRNYTASAITDLSTTARYLVVDGTYLTSPELDLSRSTEAPHVPVLMGIMRDDGAQFIDYPNASESIDTFLTDNDLPASVLASGLFPLATGPNATLDVFNTSARVATDGMFRCIDEATGYAGVVNNIFPEVYFYEFNRSYELEGQVYNGRVCYAPPTAEHPNGDPNLEYWKCHSGDLYYVFGNLRRLDQPFRDEYELPFEQYVLDSWASFIRTGDPTPDPELLKARGYANTSRAVDESGEWRPLREGDYSLRRMQWPPYQAAFDEVEQCTALDLPLDYYVGCGRLDLSLDSEEDSK

SEQ ID NO: 228 - protein, 349 aa, Aspergillus niger
  ref <308>: DATABASE ACCESSION NUMBER: UniProt A2Q8U6
  ref <309>: DATABASE ENTRY DATE: 2007-03-06
  ref <313>: RELEVANT RESIDUES IN SEQ ID NO: (1)..(349)
MPSSRWWLYVQAVVWRFLMRIGMFLHDVTPPRPPRPAFVRTIPTGSGQVRLCFYTPPNYLNIRKEGRRLPVVVNFHGGGFTLGCPTDDSRWAQCVLGEVGAVLVSVGYRRAPEHPFPAAVDDGVLALQYLAAHAVELGLDVSRIALSGFSAGGNLAITQLVSAASTSELNIVALFCWYPILDFEESRDHRRAMSLMPSKTLPAFFTDLFDESYLPTHEERISPYASPVHATDEILADALPHDIFFFICEWDMLLKEGQVFVRRLQNINKHVRAMMIEKAPHAWDKSPNPFRDQDSVDILYRDACADMKHIFDQPTRSISYVEIAKPAPPFHDNQRTRRNNEVGEGRYLS

SEQ ID NO: 229 - protein, 327 aa, Aspergillus niger
  ref <308>: DATABASE ACCESSION NUMBER: UniProt A2QZX0
  ref <309>: DATABASE ENTRY DATE: 2007-03-06
  ref <313>: RELEVANT RESIDUES IN SEQ ID NO: (1)..(327)
MENIFAKIAQDTTKFDLGDEEGWRKLYEPLYPEAPDNVGVVKDESYGPAERNRLDVYFPLEEKPGGYPVVLYVHGGGFFSGDKGWSEKRGFVTVLANHQLVPHVVYPGGADDMQLAREWISENIAKEKYGRGIPEKVVLLGHSSGGAHIAMNLYAAGDEFLDNCHLHSLLTQDIGDPKRKTNVPLFPPVAGVIYLSVPFWFDRRKPVRQRVIRHYWGSDEEEVWGSISEVSNGIEKRRPMPLWPSSMPIVNGPMSSIVGSDASTATSYPLELQIPHRRKDCWISCSLVWQKSINEFSMGRRPGIGKHHALPASEYSTTRSDKDRSEN

SEQ ID NO: 230 - protein, 530 aa, Bos taurus
  ref <308>: DATABASE ACCESSION NUMBER: UniProt O77578
  ref <309>: DATABASE ENTRY DATE: 1998-11-01
  ref <313>: RELEVANT RESIDUES IN SEQ ID NO: (1)..(530)
MQGACVLLLLGLWLQLSLAFIPVEEEDPAFWNRQAAQALDVAKKLQPIQKAAKNVILFLGDGMGVPTVTATRILKGQMNDKLGPETPLAMDQFPYVALSKTYNVDRQVPDSAGTATAYLCGVKGNYRTIGVSAAARYNQCNTTRGNEVTSVMNRAKKAGKSVGVVTTTRVQHASPAGAYAHTVNRDWYSDADLPADAQTYGCQDIATQLVNNMDIDVILGGGRKYMFPEGTPDPEYPHDASVNGVRKDKRNLVQEWQAKHQGAQYVWNRTELLQAANDSSVTHLMGLFEPADMKYNVQQDPTKDPTLEEMTEAALQVLSRNPQGFYLFVEGGRIDHGHHDSKAYMALTEAVMFDNAIAKANELTSELDTLILVTADHSHVFSFGGYTLRGTSIFGLAPSKASDKKSYTSILYGNGPGYVLGGGSRPDVNDSISEDPSYRQQAAVPLSSETHGGEDVAVFARGPQAHLVHGVQEETFVAHVMAFAGCVEPYTDCNLPAPSGLSDAAHLAASAPSLALLAGAMLLLLAPALY

SEQ ID NO: 231 - protein, 212 aa, Aspergillus niger
  ref <308>: DATABASE ACCESSION NUMBER: UniProt A2QIF8
  ref <309>: DATABASE ENTRY DATE: 2007-03-06
  ref <313>: RELEVANT RESIDUES IN SEQ ID NO: (1)..(212)
MAQERAPLRLGSVAPNFEADSSNGPITFHDYIGNSWAILFSHPDDFTPICTTELGAFAKLEPEFTARGVKLIGLSANGTESHHAWIKDIDEVNGSNLKFPIISDPERKVAYLYDMVDYQDTTNVDAKGMALTIRSVFIIDPSKKIRLIMSYPASTGRNTAEVLRVVDALQTTDKHGVTCPINWLPGDDVVIPPPVSTEDAQKKFGDIRIVKP

What is claimed is:

1. A method for producing a food product comprising a recombinant component, the method comprising:
   providing a recombinant microbial host cell genetically modified to:
   i) decrease or eliminate expression of a gene encoding a cutinase as compared to expression of the gene in an identical unmodified microbial host cell wherein the decreased or eliminated expression is due to a genetic modification in the gene encoding the cutinase, and wherein the cutinase is capable of esterase-catalyzed release of free fatty acids in a food product, and
   ii) produce the recombinant component, wherein the genetic modification to produce the recombinant component increases production of the recombinant component as compared to production of the recombinant component in an identical unmodified microbial host cell;
   allowing the recombinant microbial host cell to produce the recombinant component, and optionally purifying the recombinant component, wherein the recombinant component is suitable for incorporation into a food product; and
   incorporating the recombinant component into a food product comprising at least one of a diglyceride, a triglyceride, a phospholipid, and a lipoprotein.

2. The method of claim 1, wherein the cutinase comprises an amino acid sequence that has at least 80% sequence identity to a sequence selected from the group consisting of SEQ ID NOs: 87, 147, 153, 159, 165, 171, and 177.

3. The method of claim 2, wherein the microbial host cell is further genetically modified to decrease or eliminate expression of a gene encoding a hydrolase as compared to expression of the gene in an identical unmodified host cell wherein the decreased or eliminated expression is due to a genetic modification in the gene encoding the hydrolase and wherein the hydrolase is a hydrolase other than cutinase.

4. The method of claim 3, wherein the hydrolase is a carboxylic ester hydrolase.

5. The method of claim 4, wherein the carboxylic ester hydrolase comprises an amino acid sequence that has at least 80% sequence identity to a sequence selected from the group consisting of SEQ ID NOs: 8, 44, 73, 75, and 97.

6. The method of claim 4, wherein the carboxylic ester hydrolase comprises an amino acid sequence that has at least 80% sequence identity to SEQ ID NO: 44.

7. The method of claim 4, wherein the carboxylic ester hydrolase comprises an amino acid sequence that has at least 80% sequence identity to SEQ ID NO: 75.

8. The method of claim 4, wherein the carboxylic ester hydrolase comprises an amino acid sequence that has at least 80% sequence identity to SEQ ID NO: 8.

9. The method of claim 4, wherein the carboxylic ester hydrolase comprises an amino acid sequence that has at least 80% sequence identity to SEQ ID NO: 73.

10. The method of claim 4, wherein the carboxylic ester hydrolase comprises an amino acid sequence that has at least 80% sequence identity to SEQ ID NO: 97.

11. The method of claim 4, wherein the carboxylic ester hydrolase comprises a triacylglycerol lipase.

12. The method of claim 11, wherein the triacylglycerol lipase comprises an amino acid sequence that has at least 80% sequence identity to a sequence selected from the group consisting of SEQ ID NOs: 8, 79, and 97.

13. The method of claim 11, wherein the triacylglycerol lipase comprises an amino acid sequence that has at least 80% sequence identity to SEQ ID NO: 79.

14. The method of claim 4, wherein the carboxylic ester hydrolase comprises a phospholipase A2.

15. The method of claim 14, wherein the phospholipase A2 comprises an amino acid sequence that has at least 80% sequence identity to SEQ ID NO: 51.

16. The method of claim 4, wherein the carboxylic ester hydrolase comprises a lysophospholipase.

17. The method of claim 16, wherein the lysophospholipase comprises an amino acid sequence has at least 80% sequence identity to a sequence selected from the group consisting of SEQ ID NOs: 4, 20, 26, and 32.

18. The method of claim 4, wherein the carboxylic ester hydrolase comprises a GDSL lipase.

19. The method of claim 18, wherein the GDSL lipase comprises an amino acid sequence that has at least 80% sequence identity to a sequence selected from the group consisting of SEQ ID NOs: 63 and 200.

20. The method of claim 4, wherein the carboxylic ester hydrolase comprises an additional cutinase.

21. The method of claim 20, wherein the additional cutinase comprises an amino acid sequence that has at least 80% sequence identity to a sequence selected from the group consisting of SEQ ID NOs: 87 and 93.

22. The method of claim 1, wherein the recombinant component is a recombinant milk protein.

23. The method of claim 22, wherein the recombinant milk protein is a recombinant whey protein.

24. The method of claim 23, wherein the recombinant whey protein is a recombinant β-lactoglobulin.

25. The method of claim 1, wherein the method comprises purifying the recombinant component to obtain a preparation comprising the recombinant component and a decreased or eliminated activity of the cutinase compared to a corresponding preparation in which the recombinant component has not been purified.

26. The method of claim 25, wherein the corresponding preparation is a powder.

27. The method of claim 1, wherein the food product is a dairy product substitute of a dairy product selected from the group consisting of milk, yogurt, cheese, dairy spreads, cream, frozen confections, butter, and dairy powders.

28. The method of claim 1, wherein the genetic modification is of a control sequence or functional part thereof that drives expression of the cutinase.

29. The method of claim 1, wherein the genetic modification is of a coding sequence that encodes the cutinase or functional part thereof.

30. The method of claim 1, wherein the genetic modification is a deletion of a control sequence or functional part thereof that drives expression of the cutinase.

31. The method of claim 1, wherein the genetic modification is a deletion of a coding sequence that encodes the cutinase or functional part thereof.

* * * * *